United States Patent 8,084,598 (BIOIONFORMALITY DETECTABLE GROUP OF NOVEL REGULATORY OLIGONUCLEOTIDES AND USES THEREOF) - sequence listing, part 4

SEQ ID NO: 131134 - RNA, 20 nt, Human
ggguuuauauaaauaaaugu

SEQ ID NO: 131135 - RNA, 23 nt, Human
ggaggugggggacgggaagggac

SEQ ID NO: 131136 - RNA, 24 nt, Human
cuucagcuauacuuacacuguauu

SEQ ID NO: 131137 - RNA, 27 nt, Human
gaguuugaagucuuuacaggcgggaag

SEQ ID NO: 131138 - RNA, 21 nt, Human
cucaugaucagccugccucgg

SEQ ID NO: 131139 - RNA, 22 nt, Human
gauuacaggcgugagcccccac

SEQ ID NO: 131140 - RNA, 30 nt, Human
gcucuuuauugaagacaaacacucaccaaa

SEQ ID NO: 131141 - RNA, 25 nt, Human
ccuaggcuggagugcagugaggcaa

SEQ ID NO: 131142 - RNA, 21 nt, Human
cauagccccaaauauaguaag

SEQ ID NO: 131143 - RNA, 19 nt, Human
aauuguuuuuacugucuuu

SEQ ID NO: 131144 - RNA, 24 nt, Human
cugcagcugcacacugcucuggcc

SEQ ID NO: 131145 - RNA, 19 nt, Human
ucauucuugccuuacucca

SEQ ID NO: 131146 - RNA, 30 nt, Human
acucuuaaagcaucauuugcaccuaugugg

SEQ ID NO: 131147 - RNA, 24 nt, Human
gcuguucuccccaccccaggugcc

SEQ ID NO: 131148 - RNA, 17 nt, Human
uuucccuuauuuuguac

SEQ ID NO: 131149 - RNA, 23 nt, Human
cccauguguguggccucagucuc

SEQ ID NO: 131150 - RNA, 22 nt, Human
gacagcuauauuguauuacaaa

SEQ ID NO: 131151 - RNA, 20 nt, Human
cagaccccauauuccucaga

SEQ ID NO: 131152 - RNA, 22 nt, Human
cacuucaccucucugugccuca

SEQ ID NO: 131153 - RNA, 20 nt, Human
aguuuuucucccacuggguc

SEQ ID NO: 131154 - RNA, 31 nt, Human
uuucuccagacucgcccuccccacccgggcc

SEQ ID NO: 131155 - RNA, 23 nt, Human
cugucugcccugccucacccugc

SEQ ID NO: 131156 - RNA, 23 nt, Human
uucaacauaaauugaaucuuuaa

SEQ ID NO: 131157 - RNA, 25 nt, Human
uccucaugcuggagugccucccauu

SEQ ID NO: 131158 - RNA, 21 nt, Human
uuugcccugggccagccuuug

SEQ ID NO: 131159 - RNA, 21 nt, Human
ggaacaggagauauuucucaa

SEQ ID NO: 131160 - RNA, 23 nt, Human
agucuuucuauuccuaacuuuuc

SEQ ID NO: 131161 - RNA, 23 nt, Human
gcccuaauggccauuacuaucca

SEQ ID NO: 131162 - RNA, 21 nt, Human
agggacagacauucaaaggga

SEQ ID NO: 131163 - RNA, 26 nt, Human
gaccacuuacagugugauaaggccua

SEQ ID NO: 131164 - RNA, 22 nt, Human
ucaagaaaccacaucugguuca

SEQ ID NO: 131165 - RNA, 22 nt, Human
accagccuggccaacauggcgg

SEQ ID NO: 131166 - RNA, 24 nt, Human
uucacuucucuguauucuuccuca

SEQ ID NO: 131167 - RNA, 22 nt, Human
caaauauccuucugucuccucc

SEQ ID NO: 131168 - RNA, 26 nt, Human
gauccuuccuuaggcuuaacgacaga

SEQ ID NO: 131169 - RNA, 27 nt, Human
uggccaacauggggaaacccugucuuu

SEQ ID NO: 131170 - RNA, 21 nt, Human
gccgcaauccagccugggcgg

SEQ ID NO: 131171 - RNA, 26 nt, Human
agacuugcccaaaggagagccaggau

SEQ ID NO: 131172 - RNA, 21 nt, Human
cuauacuugggaaaaggucag

SEQ ID NO: 131173 - RNA, 20 nt, Human
cuccaccucucugugccuca

SEQ ID NO: 131174 - RNA, 27 nt, Human
cauugcacuccaaccuggacgacagag

SEQ ID NO: 131175 - RNA, 19 nt, Human
gagguugccaaaggugacu

SEQ ID NO: 131176 - RNA, 23 nt, Human
cuuuaggucauguuguaguuuaa

SEQ ID NO: 131177 - RNA, 21 nt, Human
ugcucccuccuguguggacgu

SEQ ID NO: 131178 - RNA, 20 nt, Human
ucugggguaaagucaaugua

SEQ ID NO: 131179 - RNA, 26 nt, Human
agcccugggcugccagccucaggcag

SEQ ID NO: 131180 - RNA, 22 nt, Human
uaggguucccgggaaagacugg

SEQ ID NO: 131181 - RNA, 21 nt, Human
gacacagccgccacuccccca

SEQ ID NO: 131182 - RNA, 22 nt, Human
gcaaaacucuuuuauacugaaa

SEQ ID NO: 131183 - RNA, 24 nt, Human
uagugucccuucagccugggcuga

SEQ ID NO: 131184 - RNA, 27 nt, Human
gcacagccaauggagagacccagucga

SEQ ID NO: 131185 - RNA, 23 nt, Human
gccgcccaggcuggagugcagug

SEQ ID NO: 131186 - RNA, 22 nt, Human
uggucucaaucuccugaccuug

SEQ ID NO: 131187 - RNA, 19 nt, Human
agagccccaaagcaggaag

SEQ ID NO: 131188 - RNA, 23 nt, Human
ccaccuugcaggacguuuucccc

SEQ ID NO: 131189 - RNA, 27 nt, Human
ugagauaaagcuggcuguuaucucaac

SEQ ID NO: 131190 - RNA, 26 nt, Human
aggaaguggaagcaggcuggaaagac

SEQ ID NO: 131191 - RNA, 21 nt, Human
gucccaggcuggagugcagug

SEQ ID NO: 131192 - RNA, 21 nt, Human
aucuaaaaauacuuagcacuu

SEQ ID NO: 131193 - RNA, 26 nt, Human
agaggggaguggaggcagcccauuca

SEQ ID NO: 131194 - RNA, 19 nt, Human
gagagggagaccggcaugc

SEQ ID NO: 131195 - RNA, 22 nt, Human
cggggcugacaucuacauuuuu

SEQ ID NO: 131196 - RNA, 22 nt, Human
gggaggugaacauuguugcuga

SEQ ID NO: 131197 - RNA, 27 nt, Human
cuggggccuggcuuggacagagaccag

SEQ ID NO: 131198 - RNA, 22 nt, Human
uucccauucuccuuuauuuucu

SEQ ID NO: 131199 - RNA, 19 nt, Human
aucuuccaugaaagcaauu

SEQ ID NO: 131200 - RNA, 23 nt, Human
aguucuauauuuuuugugccucu

SEQ ID NO: 131201 - RNA, 22 nt, Human
ggcuaauuuuuguacuuuuugu

SEQ ID NO: 131202 - RNA, 20 nt, Human
uuugaucuugaaucacuuga

SEQ ID NO: 131203 - RNA, 20 nt, Human
cacugcaaaagcuccugaga

SEQ ID NO: 131204 - RNA, 21 nt, Human
uggaagaacguguagacccca

SEQ ID NO: 131205 - RNA, 20 nt, Human
ugucuucucccuggaaugag

SEQ ID NO: 131206 - RNA, 22 nt, Human
cucgugggcugggaauggggga

SEQ ID NO: 131207 - RNA, 21 nt, Human
gucaccaggcuggagugcagu

SEQ ID NO: 131208 - RNA, 22 nt, Human
caaauugacuaugucacagguu

SEQ ID NO: 131209 - RNA, 17 nt, Human
ugcugcgagugaccuca

SEQ ID NO: 131210 - RNA, 21 nt, Human
uugacagagucuguguccgcu

SEQ ID NO: 131211 - RNA, 27 nt, Human
agcacccuucggcugccucccggggug

SEQ ID NO: 131212 - RNA, 20 nt, Human
ccuguguguuugucaucauc

SEQ ID NO: 131213 - RNA, 29 nt, Human
uugccuucaggcuggaugaggaagucauu

SEQ ID NO: 131214 - RNA, 27 nt, Human
acucagaucccaggucucuccguggua

SEQ ID NO: 131215 - RNA, 22 nt, Human
cucauuuaaaaaauccaauugg

SEQ ID NO: 131216 - RNA, 26 nt, Human
gcgccuagggcuggagaauagcgcug

SEQ ID NO: 131217 - RNA, 22 nt, Human
cgggcgcagaauucuucaccuu

SEQ ID NO: 131218 - RNA, 27 nt, Human
auggaaauuguauuugccuucuccacu

SEQ ID NO: 131219 - RNA, 30 nt, Human
ucacccauuaaaggauaggucuccccggag

SEQ ID NO: 131220 - RNA, 23 nt, Human
ggggagauggagcagggaaguac

SEQ ID NO: 131221 - RNA, 22 nt, Human
cacccaggcugggaauugcagu

SEQ ID NO: 131222 - RNA, 20 nt, Human
ccagagacaugggccuccca

SEQ ID NO: 131223 - RNA, 21 nt, Human
augcucuuaauuauuggcuug

SEQ ID NO: 131224 - RNA, 27 nt, Human
ugucaacaggcaggggcagcacugcag

SEQ ID NO: 131225 - RNA, 22 nt, Human
cugccuuuuaagaggucuuauc

SEQ ID NO: 131226 - RNA, 21 nt, Human
ggccucucuugggucuguguc

SEQ ID NO: 131227 - RNA, 20 nt, Human
uacauguuuacaaagagguu

SEQ ID NO: 131228 - RNA, 25 nt, Human
uuuagagugcggcugaacccgggcc

SEQ ID NO: 131229 - RNA, 27 nt, Human
uuggugccaccaacccauuuugugcca

SEQ ID NO: 131230 - RNA, 27 nt, Human
agggucugaaucccacccuuggcauug

SEQ ID NO: 131231 - RNA, 27 nt, Human
acacacuaccacauccuuucuaagcau

SEQ ID NO: 131232 - RNA, 21 nt, Human
cugagcugcaaggacaagaac

SEQ ID NO: 131233 - RNA, 26 nt, Human
ucacuggaucaagaaugcauuaagug

SEQ ID NO: 131234 - RNA, 22 nt, Human
acguuccuaauccuuugcauca

SEQ ID NO: 131235 - RNA, 22 nt, Human
gacuacaggugagugccaccac

SEQ ID NO: 131236 - RNA, 26 nt, Human
gaagaauucagauugcugaauggagu

SEQ ID NO: 131237 - RNA, 22 nt, Human
uccgcagccacuguccaaaggg

SEQ ID NO: 131238 - RNA, 26 nt, Human
cauccaggcuggccagugcugcccau

SEQ ID NO: 131239 - RNA, 23 nt, Human
gaaagagaagauugcaacuuuga

SEQ ID NO: 131240 - RNA, 25 nt, Human
aauacgugcaacaucuuaauuuuug

SEQ ID NO: 131241 - RNA, 20 nt, Human
uucuuguagcuuaacuacug

SEQ ID NO: 131242 - RNA, 24 nt, Human
gccaagcacagccucugcuccucc

SEQ ID NO: 131243 - RNA, 19 nt, Human
cauuacccuuucuuccuca

SEQ ID NO: 131244 - RNA, 26 nt, Human
gcgcccgccgcacacgcccuauucag

SEQ ID NO: 131245 - RNA, 22 nt, Human
gugaugaagaaagugugguaaa

SEQ ID NO: 131246 - RNA, 22 nt, Human
gacugucaagguggcuguuaua

SEQ ID NO: 131247 - RNA, 28 nt, Human
ugaggauuauugauaguacucuugguuu

SEQ ID NO: 131248 - RNA, 22 nt, Human
gggcucucuucuuucuuccuca

SEQ ID NO: 131249 - RNA, 25 nt, Human
gaugucaccaaaccccaguguggag

SEQ ID NO: 131250 - RNA, 27 nt, Human
uccuccaggagcggggcccugcacacc

SEQ ID NO: 131251 - RNA, 23 nt, Human
gugccccaggaugccacgccugg

SEQ ID NO: 131252 - RNA, 22 nt, Human
cagcaugcggggguugcuggug

SEQ ID NO: 131253 - RNA, 22 nt, Human
caggcuggaguacaguggugcc

SEQ ID NO: 131254 - RNA, 17 nt, Human
ccaugaucccaccugcg

SEQ ID NO: 131255 - RNA, 23 nt, Human
ucaguagaugguacgaugcaucc

SEQ ID NO: 131256 - RNA, 21 nt, Human
auaaguaaucuuauauacaag

SEQ ID NO: 131257 - RNA, 22 nt, Human
aaccugcagaacauuuuacuua

SEQ ID NO: 131258 - RNA, 21 nt, Human
acaagugcagguuucuuuuug

SEQ ID NO: 131259 - RNA, 23 nt, Human
uucaaucacuagucaagaaaaau

SEQ ID NO: 131260 - RNA, 24 nt, Human
acugauaaguaagaaacaauuaua

SEQ ID NO: 131261 - RNA, 27 nt, Human
ggaagccgaagcaggaggaucacugga

SEQ ID NO: 131262 - RNA, 23 nt, Human
uggacuugaucccucugugucuu

SEQ ID NO: 131263 - RNA, 22 nt, Human
cauuccccuccgguucuccucg

SEQ ID NO: 131264 - RNA, 21 nt, Human
uacagugucuuacagagaaaa

SEQ ID NO: 131265 - RNA, 21 nt, Human
gcuaggauaguuucaccagga

SEQ ID NO: 131266 - RNA, 22 nt, Human
auuugauuauaauaugccaagg

SEQ ID NO: 131267 - RNA, 23 nt, Human
gggagggaccgugagggagcccc

SEQ ID NO: 131268 - RNA, 26 nt, Human
ggggucagcaggaggaaaggguucac

SEQ ID NO: 131269 - RNA, 29 nt, Human
ggcacggugccucaggaagguggcgacuc

SEQ ID NO: 131270 - RNA, 22 nt, Human
ugccugguggaguugagugaug

SEQ ID NO: 131271 - RNA, 24 nt, Human
cagucuagagccuuauucuccauc

SEQ ID NO: 131272 - RNA, 24 nt, Human
gaguuggcaaaaugugauugacua

SEQ ID NO: 131273 - RNA, 25 nt, Human
gcauuuugcaucagccuggagugaa

SEQ ID NO: 131274 - RNA, 27 nt, Human
ggaggccaaggugggcagaucacugga

SEQ ID NO: 131275 - RNA, 20 nt, Human
cgccaggcuggagugcagug

SEQ ID NO: 131276 - RNA, 27 nt, Human
cacugcacuccagcagucaugggaccc

SEQ ID NO: 131277 - RNA, 23 nt, Human
ccuacuucucuacauuaugcccc

SEQ ID NO: 131278 - RNA, 27 nt, Human
agaccuccucucuaaacugcuucauug

SEQ ID NO: 131279 - RNA, 21 nt, Human
acuucccaaaagcuccaggau

SEQ ID NO: 131280 - RNA, 24 nt, Human
aagaaguugagacagggaggcagg

SEQ ID NO: 131281 - RNA, 23 nt, Human
aacacuugugguuccaagcauuu

SEQ ID NO: 131282 - RNA, 24 nt, Human
caucuguccaucccaacagcaaga

SEQ ID NO: 131283 - RNA, 29 nt, Human
cugggcgucugagcuggggugggagcucc

SEQ ID NO: 131284 - RNA, 24 nt, Human
ucaaagcaucuugcauuaugcaau

SEQ ID NO: 131285 - RNA, 19 nt, Human
caaaacguuccuggaacuc

SEQ ID NO: 131286 - RNA, 27 nt, Human
ugaacuuugucauuaugauuucauuau

SEQ ID NO: 131287 - RNA, 23 nt, Human
ugucugcagguguuaguggugug

SEQ ID NO: 131288 - RNA, 26 nt, Human
uccagaucuucaguugcuucaggcca

SEQ ID NO: 131289 - RNA, 19 nt, Human
cucgagcaguccugccuca

SEQ ID NO: 131290 - RNA, 21 nt, Human
auuguguaccugaaguacagu

SEQ ID NO: 131291 - RNA, 25 nt, Human
accucagucucccaaguagcaggga

SEQ ID NO: 131292 - RNA, 22 nt, Human
aguuugugaggaagugugcccu

SEQ ID NO: 131293 - RNA, 21 nt, Human
gggguaggagggacagagaga

SEQ ID NO: 131294 - RNA, 29 nt, Human
cucugcccggggagccucaggcaguccuc

SEQ ID NO: 131295 - RNA, 25 nt, Human
acccuguccagcacagcuucuggca

SEQ ID NO: 131296 - RNA, 22 nt, Human
ucugggauugcucacauuucuc

SEQ ID NO: 131297 - RNA, 21 nt, Human
uugccaucaagaaacauucag

SEQ ID NO: 131298 - RNA, 23 nt, Human
ccuucucuggggcuccuggaccu

SEQ ID NO: 131299 - RNA, 20 nt, Human
guuuugcccucccucucugc

SEQ ID NO: 131300 - RNA, 21 nt, Human
gcuggaacccagccaguggga

SEQ ID NO: 131301 - RNA, 23 nt, Human
aagaaauuuuuaaaaauacauug

SEQ ID NO: 131302 - RNA, 20 nt, Human
cgggagggcuuccuggacac

SEQ ID NO: 131303 - RNA, 22 nt, Human
ggacgggguggaagugggggug

SEQ ID NO: 131304 - RNA, 29 nt, Human
uccuggguugugaggagucgccgcugccg

SEQ ID NO: 131305 - RNA, 19 nt, Human
uuuccuggcuuuaccuugg

SEQ ID NO: 131306 - RNA, 23 nt, Human
uuggggagggggcaccaugcagc

SEQ ID NO: 131307 - RNA, 23 nt, Human
cacuugcuuuugaauugcacuga

SEQ ID NO: 131308 - RNA, 29 nt, Human
caccuggccgccuccaggagccuaccccc

SEQ ID NO: 131309 - RNA, 21 nt, Human
augugcaaugauggcuggauc

SEQ ID NO: 131310 - RNA, 20 nt, Human
cuuuaucagccacugccuuc

SEQ ID NO: 131311 - RNA, 24 nt, Human
ccuggagaggagcuugaagaggug

SEQ ID NO: 131312 - RNA, 25 nt, Human
uuugcaugcgcucuauucccccucu

SEQ ID NO: 131313 - RNA, 22 nt, Human
uuauuuugucaaaauguaaaca

SEQ ID NO: 131314 - RNA, 22 nt, Human
gaggcugauucuaauugucugg

SEQ ID NO: 131315 - RNA, 29 nt, Human
ggguguuggauuuucucagaugccuuuac

SEQ ID NO: 131316 - RNA, 23 nt, Human
caugcccuaucuuucauucucca

SEQ ID NO: 131317 - RNA, 27 nt, Human
gcugccucuggauagcccuggguaccc

SEQ ID NO: 131318 - RNA, 24 nt, Human
aagacagagucagccccugggcca

SEQ ID NO: 131319 - RNA, 23 nt, Human
agaggcuguuuacuggggugggg

SEQ ID NO: 131320 - RNA, 19 nt, Human
cuuuuagucugucauauca

SEQ ID NO: 131321 - RNA, 20 nt, Human
ggcagggaggggauggcaga

SEQ ID NO: 131322 - RNA, 30 nt, Human
gccugcuucugcccccuccugauuucccua

SEQ ID NO: 131323 - RNA, 22 nt, Human
ggugggccaccauguuuggacc

SEQ ID NO: 131324 - RNA, 27 nt, Human
ucccuccaccuaucccuaacaggcugu

SEQ ID NO: 131325 - RNA, 22 nt, Human
aacuucugauuucucuucagcu

SEQ ID NO: 131326 - RNA, 21 nt, Human
ccuuccuacuuugcuucucuc

SEQ ID NO: 131327 - RNA, 21 nt, Human
auucacccucucauguuuccc

SEQ ID NO: 131328 - RNA, 20 nt, Human
auguucuccacugacacaaa

SEQ ID NO: 131329 - RNA, 23 nt, Human
cucacccaggcugcagugccaug

SEQ ID NO: 131330 - RNA, 27 nt, Human
aagagccucugccgggggugggaugcc

SEQ ID NO: 131331 - RNA, 25 nt, Human
gagcaagccugugacuccaagcugg

SEQ ID NO: 131332 - RNA, 21 nt, Human
agcuguuuauugaaaugaaca

SEQ ID NO: 131333 - RNA, 20 nt, Human
uguuucaaagcacaauaacu

SEQ ID NO: 131334 - RNA, 27 nt, Human
cggguucaaguaauucuccugccucag

SEQ ID NO: 131335 - RNA, 26 nt, Human
cgcccgcacgaggggugguggccgag

SEQ ID NO: 131336 - RNA, 24 nt, Human
gauuuggaauugaacucucugccu

SEQ ID NO: 131337 - RNA, 22 nt, Human
accagccugggcaacacgguga

SEQ ID NO: 131338 - RNA, 22 nt, Human
accauuuuagaagggagaaguc

SEQ ID NO: 131339 - RNA, 22 nt, Human
ugccuaacccugaccagggaau

SEQ ID NO: 131340 - RNA, 20 nt, Human
ucaaugccaggcagugcagc

SEQ ID NO: 131341 - RNA, 22 nt, Human
ugcuugaacuggggaggcagag

SEQ ID NO: 131342 - RNA, 27 nt, Human
auacuucagaaguggggaaauggaacu

SEQ ID NO: 131343 - RNA, 25 nt, Human
cacuccagccugggcgacagagcca

SEQ ID NO: 131344 - RNA, 19 nt, Human
aauuccacaugacugaggc

SEQ ID NO: 131345 - RNA, 21 nt, Human
ccaguagcgguccuugcccau

SEQ ID NO: 131346 - RNA, 22 nt, Human
uggugcacaccuguagucccag

SEQ ID NO: 131347 - RNA, 23 nt, Human
cccugcuggcacauucaggcugu

SEQ ID NO: 131348 - RNA, 25 nt, Human
gcagagagcuuggagauaauucugg

SEQ ID NO: 131349 - RNA, 22 nt, Human
uauugagcaccuacuaugugcc

SEQ ID NO: 131350 - RNA, 28 nt, Human
guuuuuuaaugcagaauuuugucagaag

SEQ ID NO: 131351 - RNA, 24 nt, Human
ggcccccacccaccuuccuugcga

SEQ ID NO: 131352 - RNA, 23 nt, Human
uucguagaguucccucagaagag

SEQ ID NO: 131353 - RNA, 21 nt, Human
gccacaccuggugaauacuca

SEQ ID NO: 131354 - RNA, 21 nt, Human
caagugggcaggccccuccuc

SEQ ID NO: 131355 - RNA, 22 nt, Human
ucuagcuuucaaaaauuaguga

SEQ ID NO: 131356 - RNA, 27 nt, Human
gagcuaaauuauaauauuuuuguuggu

SEQ ID NO: 131357 - RNA, 19 nt, Human
auacccuggccacagagcc

SEQ ID NO: 131358 - RNA, 22 nt, Human
aauaguugauuuugaugccuuu

SEQ ID NO: 131359 - RNA, 25 nt, Human
cgaguuugcagggugcugagcugua

SEQ ID NO: 131360 - RNA, 22 nt, Human
aaucacauguucugugugcugu

SEQ ID NO: 131361 - RNA, 23 nt, Human
ccaugucuggggcaucuuccuca

SEQ ID NO: 131362 - RNA, 22 nt, Human
ucugucacccaggcuggggcgc

SEQ ID NO: 131363 - RNA, 27 nt, Human
ggugucaggagaaaguuuuguugauuu

SEQ ID NO: 131364 - RNA, 26 nt, Human
auagguggaaagagaaaugaugugaa

SEQ ID NO: 131365 - RNA, 19 nt, Human
cuuuggguuccaucuugcu

SEQ ID NO: 131366 - RNA, 22 nt, Human
augaguggaugccagaacugua

SEQ ID NO: 131367 - RNA, 20 nt, Human
cauccagcucaucacccggg

SEQ ID NO: 131368 - RNA, 25 nt, Human
cucuucagcuucccugcuguguugc

SEQ ID NO: 131369 - RNA, 22 nt, Human
gaugggguuuuaccauauugcc

SEQ ID NO: 131370 - RNA, 23 nt, Human
gcagcugguggcuuugcccucca

SEQ ID NO: 131371 - RNA, 22 nt, Human
uuuuuugaggccuuuuuugcca

SEQ ID NO: 131372 - RNA, 26 nt, Human
auuggugagaaaacaggcucaggguu

SEQ ID NO: 131373 - RNA, 22 nt, Human
gacagggccagcaggagacacc

SEQ ID NO: 131374 - RNA, 22 nt, Human
ugucccaggcuggagugcagug

SEQ ID NO: 131375 - RNA, 22 nt, Human
gacuacaguugugcaccaccac

SEQ ID NO: 131376 - RNA, 21 nt, Human
ugguucuuaagagucccagcu

SEQ ID NO: 131377 - RNA, 20 nt, Human
ucugaguacugcucucauca

SEQ ID NO: 131378 - RNA, 24 nt, Human
cuaaaugcucauugaaacaaucag

SEQ ID NO: 131379 - RNA, 22 nt, Human
auacacaccaauaucuucuuca

SEQ ID NO: 131380 - RNA, 20 nt, Human
ccagugcuccagccggugug

SEQ ID NO: 131381 - RNA, 20 nt, Human
ucagaaaaaacuacagcccu

SEQ ID NO: 131382 - RNA, 27 nt, Human
uuuagaauuuugugaaacagacuugua

SEQ ID NO: 131383 - RNA, 25 nt, Human
gccguggcaacuguggaaggcacac

SEQ ID NO: 131384 - RNA, 27 nt, Human
ggccuccggacuccucucguacuugaa

SEQ ID NO: 131385 - RNA, 19 nt, Human
auauaugauucuuuuaaac

SEQ ID NO: 131386 - RNA, 22 nt, Human
ggcuagauaacuaacaacaccu

SEQ ID NO: 131387 - RNA, 22 nt, Human
uucauucuguuugcuuaauuca

SEQ ID NO: 131388 - RNA, 26 nt, Human
ggagagaaagagugccccaaccaguc

SEQ ID NO: 131389 - RNA, 20 nt, Human
gacuacagguguguguccau

SEQ ID NO: 131390 - RNA, 27 nt, Human
cagaguugaugagcagaucuguggaag

SEQ ID NO: 131391 - RNA, 24 nt, Human
ucacacacacgcacugcccuguca

SEQ ID NO: 131392 - RNA, 24 nt, Human
uaauaccaugugacauuuaaucca

SEQ ID NO: 131393 - RNA, 24 nt, Human
ugguuccuagaggcagagguugaa

SEQ ID NO: 131394 - RNA, 20 nt, Human
ccaagguggagaaaguggag

SEQ ID NO: 131395 - RNA, 25 nt, Human
uggggaggcagggagcuagggcagg

SEQ ID NO: 131396 - RNA, 29 nt, Human
ucuguccagcuuuccccagggugacauac

SEQ ID NO: 131397 - RNA, 22 nt, Human
cccugcaggcagccccaggcuu

SEQ ID NO: 131398 - RNA, 24 nt, Human
uuucacaguccuguccucuggauc

SEQ ID NO: 131399 - RNA, 22 nt, Human
ugagggcagauucaagagccag

SEQ ID NO: 131400 - RNA, 18 nt, Human
cuccacccuccccuggug

SEQ ID NO: 131401 - RNA, 23 nt, Human
cuucugcucagcucugggccauu

SEQ ID NO: 131402 - RNA, 23 nt, Human
cccagcccaggacgaaguuuaca

SEQ ID NO: 131403 - RNA, 23 nt, Human
aucgcggcgcugcacucuagccu

SEQ ID NO: 131404 - RNA, 19 nt, Human
uccagugcuccagccuagg

SEQ ID NO: 131405 - RNA, 24 nt, Human
ccagcuuuuuaucuuucucucgac

SEQ ID NO: 131406 - RNA, 23 nt, Human
aaauuauuugcaaaaugugcuaa

SEQ ID NO: 131407 - RNA, 24 nt, Human
augaaagccauggcugggaaaaug

SEQ ID NO: 131408 - RNA, 24 nt, Human
ucccuguggagccuguuaccuccg

SEQ ID NO: 131409 - RNA, 26 nt, Human
acucgggccaggcccugaucugcgcu

SEQ ID NO: 131410 - RNA, 18 nt, Human
gggggaggaggaggcagg

SEQ ID NO: 131411 - RNA, 21 nt, Human
ucucccugcaaccuccgccuc

SEQ ID NO: 131412 - RNA, 19 nt, Human
cacccugcuugcucaccag

SEQ ID NO: 131413 - RNA, 20 nt, Human
gagauggagucucguaaagu

SEQ ID NO: 131414 - RNA, 22 nt, Human
gcacuggaguccagucucuucu

SEQ ID NO: 131415 - RNA, 25 nt, Human
ugagcucacuccaucacucgaugag

SEQ ID NO: 131416 - RNA, 27 nt, Human
agcucacuguccucuggaucugcugcg

SEQ ID NO: 131417 - RNA, 26 nt, Human
ccuucaguaucaaggcugccuggaga

SEQ ID NO: 131418 - RNA, 26 nt, Human
guaggcuuagccaguuuauuuucucu

SEQ ID NO: 131419 - RNA, 21 nt, Human
cgugcucgccucugcccagcc

SEQ ID NO: 131420 - RNA, 22 nt, Human
guugcccaggcuggagugcaau

SEQ ID NO: 131421 - RNA, 21 nt, Human
cggaaacaaaauccuuuucuu

SEQ ID NO: 131422 - RNA, 20 nt, Human
cguucuuuucugaaaaaaga

SEQ ID NO: 131423 - RNA, 20 nt, Human
gggcugaggccagagucacc

SEQ ID NO: 131424 - RNA, 24 nt, Human
cgagagcgccgguugacgugcgga

SEQ ID NO: 131425 - RNA, 22 nt, Human
gggugcacggccggcccugggc

SEQ ID NO: 131426 - RNA, 26 nt, Human
ugcccaggucaggagcaaauugaaaa

SEQ ID NO: 131427 - RNA, 27 nt, Human
uucccucuuuuccccagccucuggcaa

SEQ ID NO: 131428 - RNA, 21 nt, Human
ccagaauaaaaccaccaggaa

SEQ ID NO: 131429 - RNA, 26 nt, Human
uuccuacccuguaucuaacauaggag

SEQ ID NO: 131430 - RNA, 19 nt, Human
uagcuucuccaugcuaugu

SEQ ID NO: 131431 - RNA, 21 nt, Human
uucugccauuucaaagacuca

SEQ ID NO: 131432 - RNA, 21 nt, Human
aaaagcugcagcugucaucau

SEQ ID NO: 131433 - RNA, 21 nt, Human
cccagccuggcucuaccugcu

SEQ ID NO: 131434 - RNA, 23 nt, Human
gagcuacauucuucauugcuuua

SEQ ID NO: 131435 - RNA, 21 nt, Human
cuugggagagagcaugaaugg

SEQ ID NO: 131436 - RNA, 20 nt, Human
ccucuucucccccaccuccc

SEQ ID NO: 131437 - RNA, 26 nt, Human
ccaucagcuacaguccaaaauugcuu

SEQ ID NO: 131438 - RNA, 22 nt, Human
uucaccguguugcccaggcugg

SEQ ID NO: 131439 - RNA, 23 nt, Human
uucucuuuuguucauuuuaccuc

SEQ ID NO: 131440 - RNA, 21 nt, Human
caggcaaggggguugcagugg

SEQ ID NO: 131441 - RNA, 18 nt, Human
gcugguguuucuggaauu

SEQ ID NO: 131442 - RNA, 27 nt, Human
caccacugcaugucucuagaaugcugu

SEQ ID NO: 131443 - RNA, 21 nt, Human
auguucucuuaugaucaccau

SEQ ID NO: 131444 - RNA, 18 nt, Human
cugaaaugcauccagaca

SEQ ID NO: 131445 - RNA, 19 nt, Human
guguuuccuucccucucuc

SEQ ID NO: 131446 - RNA, 29 nt, Human
gcggcaguuugagccccuguaaauguuau

SEQ ID NO: 131447 - RNA, 19 nt, Human
gaaccccaggcuggagugc

SEQ ID NO: 131448 - RNA, 22 nt, Human
gccuguaaucccagcacuuggg

SEQ ID NO: 131449 - RNA, 22 nt, Human
uguaggggacacagaacccuuu

SEQ ID NO: 131450 - RNA, 23 nt, Human
accacacccagccucaguccucc

SEQ ID NO: 131451 - RNA, 22 nt, Human
cgggaagcagagucugcaguga

SEQ ID NO: 131452 - RNA, 23 nt, Human
augaggucaauuuccugaugcau

SEQ ID NO: 131453 - RNA, 26 nt, Human
uggaacagauauuuagcucuguggaa

SEQ ID NO: 131454 - RNA, 23 nt, Human
auucuuggguuuuccuacuuaau

SEQ ID NO: 131455 - RNA, 26 nt, Human
ucggguuugugagugaggaagggcau

SEQ ID NO: 131456 - RNA, 28 nt, Human
ugcacuauugagucuucauguucccacu

SEQ ID NO: 131457 - RNA, 21 nt, Human
cacugacagaccuuaaucuua

SEQ ID NO: 131458 - RNA, 22 nt, Human
gggacaccucaggugccaccca

SEQ ID NO: 131459 - RNA, 21 nt, Human
uucucgucuucagccgcuccu

SEQ ID NO: 131460 - RNA, 24 nt, Human
aauaagagaauuagaccccaggga

SEQ ID NO: 131461 - RNA, 22 nt, Human
ccacggcacuccagccugggug

SEQ ID NO: 131462 - RNA, 27 nt, Human
gcucaagccauccauccuccuaccuca

SEQ ID NO: 131463 - RNA, 23 nt, Human
accugcagggaucauagcugacu

SEQ ID NO: 131464 - RNA, 22 nt, Human
cuccagccucucagcccugugc

SEQ ID NO: 131465 - RNA, 24 nt, Human
ggcaaaguggcaccgggcgccgag

SEQ ID NO: 131466 - RNA, 20 nt, Human
guuauucuuugaucugcauu

SEQ ID NO: 131467 - RNA, 16 nt, Human
cauguccuucacaagg

SEQ ID NO: 131468 - RNA, 19 nt, Human
cagcauuuguugauugaau

SEQ ID NO: 131469 - RNA, 23 nt, Human
cugucucucuguggggagggcuu

SEQ ID NO: 131470 - RNA, 27 nt, Human
ccccaacaaugugaggggucccuagca

SEQ ID NO: 131471 - RNA, 25 nt, Human
ggagagggcgggguagggaugcagc

SEQ ID NO: 131472 - RNA, 26 nt, Human
aaaugcugguuaaacaggaaugcuua

SEQ ID NO: 131473 - RNA, 25 nt, Human
ccuuccucaucugugccugucuguc

SEQ ID NO: 131474 - RNA, 26 nt, Human
gaagaggccuguuucgcugucggguc

SEQ ID NO: 131475 - RNA, 19 nt, Human
accagccuguuuagcagug

SEQ ID NO: 131476 - RNA, 20 nt, Human
ggacugcucaguggccaggu

SEQ ID NO: 131477 - RNA, 27 nt, Human
ugcccccggcggaaaucuccaaaaauc

SEQ ID NO: 131478 - RNA, 20 nt, Human
cuacauguaaugacacuucu

SEQ ID NO: 131479 - RNA, 23 nt, Human
cgccugucugugugcaucauguu

SEQ ID NO: 131480 - RNA, 21 nt, Human
cacucacuggccucgcucccc

SEQ ID NO: 131481 - RNA, 22 nt, Human
cgcaguuugaccccacgcccag

SEQ ID NO: 131482 - RNA, 23 nt, Human
uguccaaaaucacacaacuugua

SEQ ID NO: 131483 - RNA, 25 nt, Human
cugauuuaauaaaugguucauuuua

SEQ ID NO: 131484 - RNA, 18 nt, Human
ugggaucauuugagguca

SEQ ID NO: 131485 - RNA, 27 nt, Human
cccaaagugcugggauuacaaggguga

SEQ ID NO: 131486 - RNA, 32 nt, Human
ucccccagggcucacuggaguggcagauauag

SEQ ID NO: 131487 - RNA, 21 nt, Human
uaggacuguugaacaaucccg

SEQ ID NO: 131488 - RNA, 23 nt, Human
ggcagucucacaagcacgcagca

SEQ ID NO: 131489 - RNA, 22 nt, Human
ugucgccaaguuggagugcaau

SEQ ID NO: 131490 - RNA, 27 nt, Human
cugcuucuguagcccacggcaccccaa

SEQ ID NO: 131491 - RNA, 23 nt, Human
uacauucugcaagcacaucugca

SEQ ID NO: 131492 - RNA, 21 nt, Human
guuggaggaaagaugagugaa

SEQ ID NO: 131493 - RNA, 22 nt, Human
guuugccucugccucugacaca

SEQ ID NO: 131494 - RNA, 21 nt, Human
uuccacaguuuuacauucaug

SEQ ID NO: 131495 - RNA, 20 nt, Human
uagagugcuuuuuguuuaaa

SEQ ID NO: 131496 - RNA, 29 nt, Human
acuuuuuaauuaaaucaaaggucgacgcg

SEQ ID NO: 131497 - RNA, 23 nt, Human
aucgugccacugcacuccagccu

SEQ ID NO: 131498 - RNA, 23 nt, Human
aucaugccacugcacuccaaccu

SEQ ID NO: 131499 - RNA, 20 nt, Human
ccucacacuggcgucuggac

SEQ ID NO: 131500 - RNA, 26 nt, Human
ucugucacuacaccugcagcaccacg

SEQ ID NO: 131501 - RNA, 21 nt, Human
cacuugaacgugggaggcgga

SEQ ID NO: 131502 - RNA, 24 nt, Human
cacuauauaauucgcacacauuaa

SEQ ID NO: 131503 - RNA, 27 nt, Human
gggcaccacucucuagggagcccacac

SEQ ID NO: 131504 - RNA, 25 nt, Human
ggccucaagugauccacccaccuca

SEQ ID NO: 131505 - RNA, 22 nt, Human
ggaucacugccaaaaugguaca

SEQ ID NO: 131506 - RNA, 27 nt, Human
agcucugcuccuaacuccugcccgccc

SEQ ID NO: 131507 - RNA, 23 nt, Human
uuucaacuucugugaaagccaac

SEQ ID NO: 131508 - RNA, 19 nt, Human
uguuuaauguucugugaua

SEQ ID NO: 131509 - RNA, 22 nt, Human
cccagaucgcgacacugcacuc

SEQ ID NO: 131510 - RNA, 22 nt, Human
ggcuaauuuucauauuuuucag

SEQ ID NO: 131511 - RNA, 20 nt, Human
cgggucagggugaccucugg

SEQ ID NO: 131512 - RNA, 20 nt, Human
aggucucucuggcucuagga

SEQ ID NO: 131513 - RNA, 24 nt, Human
guuuucuuaaaauaaaaugcagag

SEQ ID NO: 131514 - RNA, 23 nt, Human
acuuucuuccuccuguuucucgu

SEQ ID NO: 131515 - RNA, 23 nt, Human
cccuccagcgagucccaggagag

SEQ ID NO: 131516 - RNA, 21 nt, Human
cugggagccacugggaggggg

SEQ ID NO: 131517 - RNA, 23 nt, Human
aaucucaaaacacucuacucugg

SEQ ID NO: 131518 - RNA, 20 nt, Human
aaagauagagaaugcccuca

SEQ ID NO: 131519 - RNA, 21 nt, Human
gccuuucugcugccuuggguu

SEQ ID NO: 131520 - RNA, 23 nt, Human
gccccgaaccucaccugaccuca

SEQ ID NO: 131521 - RNA, 30 nt, Human
uauggccccucuuaaccaugcugguguuau

SEQ ID NO: 131522 - RNA, 22 nt, Human
ccagggcuugcagaucgcagug

SEQ ID NO: 131523 - RNA, 20 nt, Human
caacagcacacaggcagcca

SEQ ID NO: 131524 - RNA, 21 nt, Human
caguacagcuauccagagaga

SEQ ID NO: 131525 - RNA, 27 nt, Human
cuuggauccugggguagggaggcaggg

SEQ ID NO: 131526 - RNA, 22 nt, Human
gcaucuucucacugugcugcaa

SEQ ID NO: 131527 - RNA, 21 nt, Human
aguccacaccuguggucccag

SEQ ID NO: 131528 - RNA, 22 nt, Human
caugcgccgcccuccuccaucg

SEQ ID NO: 131529 - RNA, 23 nt, Human
uuugaggcccaauaacucuugcc

SEQ ID NO: 131530 - RNA, 22 nt, Human
ucugccucugugccuauggguu

SEQ ID NO: 131531 - RNA, 24 nt, Human
ccuuccaugcugugcagcacuucu

SEQ ID NO: 131532 - RNA, 24 nt, Human
uaccuugcauaaguccucauucua

SEQ ID NO: 131533 - RNA, 20 nt, Human
uauugccuuuuaauuuuuaa

SEQ ID NO: 131534 - RNA, 22 nt, Human
cucuggcuuuugagaugacuua

SEQ ID NO: 131535 - RNA, 27 nt, Human
gagggacaggcaggcagcaggaggggc

SEQ ID NO: 131536 - RNA, 22 nt, Human
cgaacuccugggcucaagccgu

SEQ ID NO: 131537 - RNA, 23 nt, Human
cacuggcagugggaagaggcaga

SEQ ID NO: 131538 - RNA, 22 nt, Human
aucuuuucagcacuuaauuuua

SEQ ID NO: 131539 - RNA, 23 nt, Human
ccagcucuuccgcuccucucaca

SEQ ID NO: 131540 - RNA, 20 nt, Human
ugaaauauacauacuaggca

SEQ ID NO: 131541 - RNA, 24 nt, Human
gccuuucucccccaacccaaggcu

SEQ ID NO: 131542 - RNA, 21 nt, Human
cgccuguggucucagcacuuu

SEQ ID NO: 131543 - RNA, 21 nt, Human
agcgcucgcucuacucucucu

SEQ ID NO: 131544 - RNA, 22 nt, Human
gaccagccuggucaagauggug

SEQ ID NO: 131545 - RNA, 22 nt, Human
gacuagccuggccaagauggug

SEQ ID NO: 131546 - RNA, 23 nt, Human
uucauucuuucuuugcacguuca

SEQ ID NO: 131547 - RNA, 22 nt, Human
uuuauggucgugcccuucccuc

SEQ ID NO: 131548 - RNA, 23 nt, Human
cccagcaccugccuccucguucc

SEQ ID NO: 131549 - RNA, 19 nt, Human
caaacaaggcagacuugca

SEQ ID NO: 131550 - RNA, 18 nt, Human
gggugaguccuccagaac

SEQ ID NO: 131551 - RNA, 20 nt, Human
cccaggcugggagggcaaug

SEQ ID NO: 131552 - RNA, 28 nt, Human
ggggaggucuuagcaggagcgggcccug

SEQ ID NO: 131553 - RNA, 27 nt, Human
gagacuccaggaucgguucuuucaucu

SEQ ID NO: 131554 - RNA, 27 nt, Human
uaucuggaggaagaaaacaggugaaag

SEQ ID NO: 131555 - RNA, 19 nt, Human
cugcucaggagccagcaca

SEQ ID NO: 131556 - RNA, 29 nt, Human
cuucucucucgccucuccuccgccucugg

SEQ ID NO: 131557 - RNA, 19 nt, Human
gcuccuggagcuucacugg

SEQ ID NO: 131558 - RNA, 21 nt, Human
cucaaacauuuuucaauuaug

SEQ ID NO: 131559 - RNA, 23 nt, Human
guagacugauuacacugagguga

SEQ ID NO: 131560 - RNA, 19 nt, Human
acuuugacagcuuuuaugu

SEQ ID NO: 131561 - RNA, 21 nt, Human
cagagucuugcucugucgcca

SEQ ID NO: 131562 - RNA, 27 nt, Human
ggccucuucugcuuucucgggaauuuu

SEQ ID NO: 131563 - RNA, 23 nt, Human
caaaacaauguguguugugagcc

SEQ ID NO: 131564 - RNA, 23 nt, Human
cuugucuggaugcggcucugagu

SEQ ID NO: 131565 - RNA, 22 nt, Human
cucauuucguccucuuucccca

SEQ ID NO: 131566 - RNA, 22 nt, Human
ucaauagaucugggauuaugug

SEQ ID NO: 131567 - RNA, 25 nt, Human
uuuguacguucuucuauugugcuuu

SEQ ID NO: 131568 - RNA, 24 nt, Human
agcuucaaaaugagauaugcaaua

SEQ ID NO: 131569 - RNA, 20 nt, Human
agccccugcgcgcucaggga

SEQ ID NO: 131570 - RNA, 21 nt, Human
uguuaaaauaacuaguguugc

SEQ ID NO: 131571 - RNA, 27 nt, Human
aaccagguuccgacaguccagcccaga

SEQ ID NO: 131572 - RNA, 22 nt, Human
uuccaaaaucucccauuuugga

SEQ ID NO: 131573 - RNA, 26 nt, Human
ccagcuguuuaacacuauccugggca

SEQ ID NO: 131574 - RNA, 28 nt, Human
aaaggacagagacccucagacugaugaa

SEQ ID NO: 131575 - RNA, 21 nt, Human
acugcugguccaagugugugg

SEQ ID NO: 131576 - RNA, 23 nt, Human
uguugcaggcugaagugggggau

SEQ ID NO: 131577 - RNA, 22 nt, Human
gcgcacacacacuugcauucau

SEQ ID NO: 131578 - RNA, 19 nt, Human
caaacacucaccaaaaaga

SEQ ID NO: 131579 - RNA, 26 nt, Human
uggucucaaagccagucccagccuga

SEQ ID NO: 131580 - RNA, 23 nt, Human
guagggauuaucgcgagugguug

SEQ ID NO: 131581 - RNA, 26 nt, Human
cugcgggaugguccuggggcucugug

SEQ ID NO: 131582 - RNA, 21 nt, Human
ucacaucuuuggaucuguaaa

SEQ ID NO: 131583 - RNA, 22 nt, Human
augccccagggcugaggccucc

SEQ ID NO: 131584 - RNA, 21 nt, Human
agugcugccucacauugggcc

SEQ ID NO: 131585 - RNA, 20 nt, Human
acauuugaggauggacuuaa

SEQ ID NO: 131586 - RNA, 22 nt, Human
gaagaacaaaugacucagaaug

SEQ ID NO: 131587 - RNA, 26 nt, Human
uccccgcugcugugcugggcccgggg

SEQ ID NO: 131588 - RNA, 27 nt, Human
cagugcacuccuggagccaagagggaa

SEQ ID NO: 131589 - RNA, 19 nt, Human
ucaggcacaggaagugggc

SEQ ID NO: 131590 - RNA, 20 nt, Human
cuggguggaauggggcugaa

SEQ ID NO: 131591 - RNA, 22 nt, Human
auuuuugcagaacaggcagcag

SEQ ID NO: 131592 - RNA, 23 nt, Human
agagcugcugagcaggaaccgga

SEQ ID NO: 131593 - RNA, 25 nt, Human
gcugagccuccugaaaacccaugaa

SEQ ID NO: 131594 - RNA, 20 nt, Human
cuauauuuugcuuugacaga

SEQ ID NO: 131595 - RNA, 24 nt, Human
gggggaagaagagagggugggaga

SEQ ID NO: 131596 - RNA, 22 nt, Human
gcaguguaacccaagcauuugu

SEQ ID NO: 131597 - RNA, 24 nt, Human
ggugccucacgccuguaaucccag

SEQ ID NO: 131598 - RNA, 21 nt, Human
uguugcccagacuggucucga

SEQ ID NO: 131599 - RNA, 18 nt, Human
gggguggccacaggcuag

SEQ ID NO: 131600 - RNA, 20 nt, Human
gcccgcugagcaggcugcca

SEQ ID NO: 131601 - RNA, 20 nt, Human
acaucacauuaaagcuuuuc

SEQ ID NO: 131602 - RNA, 22 nt, Human
cccagcacugugggggccuuca

SEQ ID NO: 131603 - RNA, 20 nt, Human
cuuucccuccccauccucug

SEQ ID NO: 131604 - RNA, 20 nt, Human
gucccugagcuuggaaauua

SEQ ID NO: 131605 - RNA, 19 nt, Human
gugguuuuuaccacuguac

SEQ ID NO: 131606 - RNA, 20 nt, Human
ucaccgagugaccaccaaga

SEQ ID NO: 131607 - RNA, 22 nt, Human
gccugcaggaagcugaacuuug

SEQ ID NO: 131608 - RNA, 16 nt, Human
aucuaaaaauguuuac

SEQ ID NO: 131609 - RNA, 21 nt, Human
ucuucaaagcagagugggacu

SEQ ID NO: 131610 - RNA, 24 nt, Human
cuauccuucucugccucuuaacuc

SEQ ID NO: 131611 - RNA, 20 nt, Human
ccuucucuuuguuuuuugca

SEQ ID NO: 131612 - RNA, 24 nt, Human
cucuccucuuugaugucaaacgcc

SEQ ID NO: 131613 - RNA, 22 nt, Human
ccucauuccuccuguucuccca

SEQ ID NO: 131614 - RNA, 26 nt, Human
uucaaaacaugucacccaagcucugu

SEQ ID NO: 131615 - RNA, 22 nt, Human
uuuacccaggcuggagugcaau

SEQ ID NO: 131616 - RNA, 29 nt, Human
uuucucguugaguucuccccacugaaugu

SEQ ID NO: 131617 - RNA, 26 nt, Human
ucaagaauacaugugcugcuuuaccg

SEQ ID NO: 131618 - RNA, 24 nt, Human
guuuuguguaucuguacucucugc

SEQ ID NO: 131619 - RNA, 21 nt, Human
ucccacacccuuuacauuccc

SEQ ID NO: 131620 - RNA, 20 nt, Human
ccagagcccagagcaaccag

SEQ ID NO: 131621 - RNA, 21 nt, Human
ggccuggauucguggccugga

SEQ ID NO: 131622 - RNA, 22 nt, Human
ugggcuaggguggucagaggaa

SEQ ID NO: 131623 - RNA, 20 nt, Human
caauaugacaaaaaguuuaa

SEQ ID NO: 131624 - RNA, 26 nt, Human
guuccuaagcuggagugcuuaucccu

SEQ ID NO: 131625 - RNA, 31 nt, Human
cccagcgucugacgcuggagugcucacagug

SEQ ID NO: 131626 - RNA, 23 nt, Human
cgucggcccagacugaagugcag

SEQ ID NO: 131627 - RNA, 20 nt, Human
agacaaugcccccacgcuug

SEQ ID NO: 131628 - RNA, 27 nt, Human
augcuucccccgccaaccagcuccugc

SEQ ID NO: 131629 - RNA, 22 nt, Human
gcccccagugucccauccucuc

SEQ ID NO: 131630 - RNA, 22 nt, Human
gucuugucuucuuuuuaauuua

SEQ ID NO: 131631 - RNA, 23 nt, Human
aggcuguguuuggcuuucaggga

SEQ ID NO: 131632 - RNA, 24 nt, Human
cauucugaaguuacuggagcaugg

SEQ ID NO: 131633 - RNA, 25 nt, Human
agggcuggauagguaugcagaggag

SEQ ID NO: 131634 - RNA, 24 nt, Human
gugauuuuucuuuaucaagagaac

SEQ ID NO: 131635 - RNA, 22 nt, Human
gcaggggaaauguauuuaugca

SEQ ID NO: 131636 - RNA, 25 nt, Human
gaucaaauuaaaagacaauaaaugg

SEQ ID NO: 131637 - RNA, 18 nt, Human
accauaaagggugccagg

SEQ ID NO: 131638 - RNA, 22 nt, Human
agagcuuagccccuggaggcag

SEQ ID NO: 131639 - RNA, 21 nt, Human
gggccgccuaccuuugcuggu

SEQ ID NO: 131640 - RNA, 19 nt, Human
uugucucccagugcauuuu

SEQ ID NO: 131641 - RNA, 21 nt, Human
ucggccaggcuggagugcagu

SEQ ID NO: 131642 - RNA, 22 nt, Human
gcugggguugcaucauuucccc

SEQ ID NO: 131643 - RNA, 27 nt, Human
uacuguacuccagccagggcaagagag

SEQ ID NO: 131644 - RNA, 26 nt, Human
uguccucccucacccccuccuucaua

SEQ ID NO: 131645 - RNA, 27 nt, Human
gugggcugcggugauggguguuuuggg

SEQ ID NO: 131646 - RNA, 20 nt, Human
gagaguuuggugauacuguc

SEQ ID NO: 131647 - RNA, 19 nt, Human
ggauggccucaggccaggu

SEQ ID NO: 131648 - RNA, 23 nt, Human
uauuugaccucccacuacccaga

SEQ ID NO: 131649 - RNA, 26 nt, Human
gguacugauggagccugcagcgcccg

SEQ ID NO: 131650 - RNA, 26 nt, Human
ucgggaggcugagacaggagaaucgc

SEQ ID NO: 131651 - RNA, 18 nt, Human
caauuuuaagaccagaaa

SEQ ID NO: 131652 - RNA, 22 nt, Human
cuguuuuuaaaaaggugcuaca

SEQ ID NO: 131653 - RNA, 22 nt, Human
ucucccuccagcuccacucgcu

SEQ ID NO: 131654 - RNA, 23 nt, Human
gcaccugcagucacccacacucu

SEQ ID NO: 131655 - RNA, 21 nt, Human
gccuguaauucuagcacuuug

SEQ ID NO: 131656 - RNA, 21 nt, Human
gccuguaauccuagcaccuug

SEQ ID NO: 131657 - RNA, 18 nt, Human
ccauguuauucucucaca

SEQ ID NO: 131658 - RNA, 28 nt, Human
agaaucuucacuccaggcacauagcccc

SEQ ID NO: 131659 - RNA, 27 nt, Human
guguccuggaaucuauaugaaaaagau

SEQ ID NO: 131660 - RNA, 21 nt, Human
aagcaaagcucuggcucacag

SEQ ID NO: 131661 - RNA, 21 nt, Human
auccaaagaaaaagguuuaaa

SEQ ID NO: 131662 - RNA, 21 nt, Human
ccugcagguauuuucuuuuua

SEQ ID NO: 131663 - RNA, 21 nt, Human
ggugacuguauagcugggauu

SEQ ID NO: 131664 - RNA, 27 nt, Human
ucacccaggcacugggcaagugaagag

SEQ ID NO: 131665 - RNA, 21 nt, Human
cuaagaucaaaccccauggag

SEQ ID NO: 131666 - RNA, 27 nt, Human
gucccugcuucgauggccccaaagcug

SEQ ID NO: 131667 - RNA, 26 nt, Human
agccaacuuggcuuucccggacugca

SEQ ID NO: 131668 - RNA, 26 nt, Human
gaagagcuaggguagagaaggacgca

SEQ ID NO: 131669 - RNA, 18 nt, Human
cugcuucuuuucugaccg

SEQ ID NO: 131670 - RNA, 22 nt, Human
uguagcccaggcuggagugcaa

SEQ ID NO: 131671 - RNA, 23 nt, Human
gagggcccacugcacagcauauc

SEQ ID NO: 131672 - RNA, 22 nt, Human
cuccagccacacccccugccuu

SEQ ID NO: 131673 - RNA, 31 nt, Human
gguggagcuucccucacagaccccaucuggu

SEQ ID NO: 131674 - RNA, 25 nt, Human
gcuugaaaggguagaaguaagacau

SEQ ID NO: 131675 - RNA, 20 nt, Human
ggcugcuagaagcacgaucc

SEQ ID NO: 131676 - RNA, 27 nt, Human
agcauuguaauuauguaaauaacucua

SEQ ID NO: 131677 - RNA, 25 nt, Human
auaaagcauuugaaugguacaguag

SEQ ID NO: 131678 - RNA, 26 nt, Human
augcagaugccugggccguagcuugu

SEQ ID NO: 131679 - RNA, 21 nt, Human
aucagaggugauuuuuucuua

SEQ ID NO: 131680 - RNA, 25 nt, Human
ccuccaggcccugccuugucccugc

SEQ ID NO: 131681 - RNA, 27 nt, Human
uuucaacaaauggcaccgagacaauga

SEQ ID NO: 131682 - RNA, 22 nt, Human
uuucuauuguuuauucuuuuua

SEQ ID NO: 131683 - RNA, 24 nt, Human
ggggcucaguucugccuuaucuaa

SEQ ID NO: 131684 - RNA, 22 nt, Human
cgccuaugaucccagcacuuug

SEQ ID NO: 131685 - RNA, 23 nt, Human
caaaaucaaaguuucagcaaugg

SEQ ID NO: 131686 - RNA, 21 nt, Human
ucacugcagccucaaccucuc

SEQ ID NO: 131687 - RNA, 23 nt, Human
cuaccucagaucuaaucaauuag

SEQ ID NO: 131688 - RNA, 20 nt, Human
uucagaagaaaagcauuuaa

SEQ ID NO: 131689 - RNA, 22 nt, Human
gcucacguauguaaucccagca

SEQ ID NO: 131690 - RNA, 20 nt, Human
acucuuuuuacccaggcugg

SEQ ID NO: 131691 - RNA, 21 nt, Human
cucauuucuguauauuccuuu

SEQ ID NO: 131692 - RNA, 22 nt, Human
agcuguggcagaguuacaguuc

SEQ ID NO: 131693 - RNA, 21 nt, Human
cagaaccucucuuuucuaaga

SEQ ID NO: 131694 - RNA, 27 nt, Human
cuccuaugcacagagcagaggagggag

SEQ ID NO: 131695 - RNA, 21 nt, Human
agucuccuuuaaaugcacauu

SEQ ID NO: 131696 - RNA, 22 nt, Human
ggagaggggagaauggaguaga

SEQ ID NO: 131697 - RNA, 24 nt, Human
cugaugugcccaccaccgugucau

SEQ ID NO: 131698 - RNA, 19 nt, Human
cugccucccacccuguguc

SEQ ID NO: 131699 - RNA, 22 nt, Human
uuccaauaccaacucaccuaca

SEQ ID NO: 131700 - RNA, 17 nt, Human
gccucuauuguuccaug

SEQ ID NO: 131701 - RNA, 24 nt, Human
agcauucuuauguggcugcuuuau

SEQ ID NO: 131702 - RNA, 22 nt, Human
gccuguaaucccagcacuuugg

SEQ ID NO: 131703 - RNA, 22 nt, Human
gccuguaaucccaacacuuuga

SEQ ID NO: 131704 - RNA, 22 nt, Human
gccuguaaucucagcacucugg

SEQ ID NO: 131705 - RNA, 17 nt, Human
aggcuguaacuacuuua

SEQ ID NO: 131706 - RNA, 22 nt, Human
ugcagugaaccaagaucacgcc

SEQ ID NO: 131707 - RNA, 24 nt, Human
cucugcaggaugggcacagugcug

SEQ ID NO: 131708 - RNA, 19 nt, Human
acuauggcuaccaaaaaga

SEQ ID NO: 131709 - RNA, 21 nt, Human
uauuaaaaugaauauuuuugu

SEQ ID NO: 131710 - RNA, 21 nt, Human
uuuuuguacagggaaguuuaa

SEQ ID NO: 131711 - RNA, 22 nt, Human
uucaaguaauucuccugccuca

SEQ ID NO: 131712 - RNA, 17 nt, Human
cuucccuuugguugccc

SEQ ID NO: 131713 - RNA, 26 nt, Human
uccuuugauggagguuagggacuguc

SEQ ID NO: 131714 - RNA, 21 nt, Human
uuggccuauguuguuagaaau

SEQ ID NO: 131715 - RNA, 27 nt, Human
ggagucagaggugccuccaggagcagc

SEQ ID NO: 131716 - RNA, 21 nt, Human
uauaggagucacguucuuuaa

SEQ ID NO: 131717 - RNA, 28 nt, Human
ucuagccuggccgcggccuuucgcugag

SEQ ID NO: 131718 - RNA, 21 nt, Human
gaguugaguuuaacaauccua

SEQ ID NO: 131719 - RNA, 28 nt, Human
acuauccugcggguuuuaauuuauuuca

SEQ ID NO: 131720 - RNA, 24 nt, Human
uuccacacaugugguugugcacau

SEQ ID NO: 131721 - RNA, 22 nt, Human
gugagacaaagggcgcuggcug

SEQ ID NO: 131722 - RNA, 23 nt, Human
caggagguggugggcucgcagga

SEQ ID NO: 131723 - RNA, 22 nt, Human
cagauagcagagggguaagaga

SEQ ID NO: 131724 - RNA, 19 nt, Human
ccugggugggaggagcgaa

SEQ ID NO: 131725 - RNA, 26 nt, Human
agccccaucacauuugugauacugac

SEQ ID NO: 131726 - RNA, 20 nt, Human
ggcuuuagcgguucuugccu

SEQ ID NO: 131727 - RNA, 21 nt, Human
aauaaaucugcagagauugaa

SEQ ID NO: 131728 - RNA, 22 nt, Human
gggauuacagacacgagccacc

SEQ ID NO: 131729 - RNA, 22 nt, Human
gggauuacagacaugagccacu

SEQ ID NO: 131730 - RNA, 20 nt, Human
ucaugcgaugccuggaacac

SEQ ID NO: 131731 - RNA, 19 nt, Human
ggaggcuggagcaggguca

SEQ ID NO: 131732 - RNA, 21 nt, Human
uccagccuggguggcagagug

SEQ ID NO: 131733 - RNA, 21 nt, Human
uucagguccugagauuacacg

SEQ ID NO: 131734 - RNA, 21 nt, Human
ugccaccucauguucacaccu

SEQ ID NO: 131735 - RNA, 27 nt, Human
ucaacagcaaucaucuuuggggaaugg

SEQ ID NO: 131736 - RNA, 27 nt, Human
ccuuccuaucggcgacucccaggaucc

SEQ ID NO: 131737 - RNA, 21 nt, Human
aaggagaauuguauuucucca

SEQ ID NO: 131738 - RNA, 26 nt, Human
ccuuuuccuugacuucucaacccagc

SEQ ID NO: 131739 - RNA, 23 nt, Human
agccgcuucuaccugcugcugcu

SEQ ID NO: 131740 - RNA, 26 nt, Human
agcaggagcaugauggggacuuccau

SEQ ID NO: 131741 - RNA, 22 nt, Human
ugccacuguacuccagccuggg

SEQ ID NO: 131742 - RNA, 22 nt, Human
ggcuggaggaugggcagagggg

SEQ ID NO: 131743 - RNA, 22 nt, Human
cgccacugcacuccagccuggg

SEQ ID NO: 131744 - RNA, 22 nt, Human
caccauugcgcucuagccuggg

SEQ ID NO: 131745 - RNA, 23 nt, Human
guggcuggcaucaccacgcccag

SEQ ID NO: 131746 - RNA, 23 nt, Human
ggagccaagucacaaucuuucuc

SEQ ID NO: 131747 - RNA, 23 nt, Human
cacaacaguuuguuaauucuuca

SEQ ID NO: 131748 - RNA, 27 nt, Human
gaggguucugagaggaggcagcaaucc

SEQ ID NO: 131749 - RNA, 22 nt, Human
caggaguucgaggcugcaguca

SEQ ID NO: 131750 - RNA, 22 nt, Human
cacugcacuccagucuggauga

SEQ ID NO: 131751 - RNA, 22 nt, Human
cacuguacuccagccuggauga

SEQ ID NO: 131752 - RNA, 26 nt, Human
gggaagggagggguuacuccuccucc

SEQ ID NO: 131753 - RNA, 26 nt, Human
gggagaauggguguuguauggggagg

SEQ ID NO: 131754 - RNA, 26 nt, Human
accacuaugcccggcuaauuuuuugg

SEQ ID NO: 131755 - RNA, 27 nt, Human
ugaaaacaacuacucucugagcagcug

SEQ ID NO: 131756 - RNA, 21 nt, Human
gagggucccugcuggcacauu

SEQ ID NO: 131757 - RNA, 26 nt, Human
cagcuuucugcuucuuucuuuuuggg

SEQ ID NO: 131758 - RNA, 24 nt, Human
gguaccugacaacaagagcauuuu

SEQ ID NO: 131759 - RNA, 22 nt, Human
cagaaaagucuggaauaauguu

SEQ ID NO: 131760 - RNA, 20 nt, Human
cagaacauauuuucuguuca

SEQ ID NO: 131761 - RNA, 22 nt, Human
aaagaagucuuaagauauuuca

SEQ ID NO: 131762 - RNA, 26 nt, Human
ggucaauauuaugaaaauaauuuuua

SEQ ID NO: 131763 - RNA, 23 nt, Human
gaagugauucuguugacaauaau

SEQ ID NO: 131764 - RNA, 27 nt, Human
gcugucgucccccuccagugcuuggcu

SEQ ID NO: 131765 - RNA, 22 nt, Human
gaacccagguuucuugauuccc

SEQ ID NO: 131766 - RNA, 20 nt, Human
ucuguuggcuccaccuccag

SEQ ID NO: 131767 - RNA, 28 nt, Human
ccucagugggaggggcucugagaacgac

SEQ ID NO: 131768 - RNA, 20 nt, Human
agugggagguugugcaugga

SEQ ID NO: 131769 - RNA, 21 nt, Human
uucauucacuuuaauagaagg

SEQ ID NO: 131770 - RNA, 21 nt, Human
ucugggucaucagcauguccc

SEQ ID NO: 131771 - RNA, 23 nt, Human
uggcaagaccaucaagacuguuc

SEQ ID NO: 131772 - RNA, 23 nt, Human
ccuagaagguuuauacugccuuc

SEQ ID NO: 131773 - RNA, 26 nt, Human
ggacuuuucugcuauuuacugcucuu

SEQ ID NO: 131774 - RNA, 23 nt, Human
ccucagcagaauaacaaaaacuu

SEQ ID NO: 131775 - RNA, 20 nt, Human
uccuggugauucugaugcag

SEQ ID NO: 131776 - RNA, 28 nt, Human
uccagccccucacgccuccucucagucu

SEQ ID NO: 131777 - RNA, 23 nt, Human
cuuugcagggagucguggguucu

SEQ ID NO: 131778 - RNA, 25 nt, Human
cucccucugauccuccaucagggcc

SEQ ID NO: 131779 - RNA, 18 nt, Human
ggccccggggccaccuca

SEQ ID NO: 131780 - RNA, 24 nt, Human
uucuaauucucuuuguaugcuugg

SEQ ID NO: 131781 - RNA, 20 nt, Human
gauuauuucaaagguaguuu

SEQ ID NO: 131782 - RNA, 26 nt, Human
ggcaguacucaacaugaucacagagg

SEQ ID NO: 131783 - RNA, 23 nt, Human
auuaacuuauuuaugugcugcug

SEQ ID NO: 131784 - RNA, 26 nt, Human
auggaaaggagaggaaagaacucagu

SEQ ID NO: 131785 - RNA, 25 nt, Human
gggcuugcuaacuguugagcuguuu

SEQ ID NO: 131786 - RNA, 25 nt, Human
ugagagccauuggaagacuguccuc

SEQ ID NO: 131787 - RNA, 24 nt, Human
ucuuugcuccaaugucaccuccuc

SEQ ID NO: 131788 - RNA, 21 nt, Human
ugugggcuggggagccuugga

SEQ ID NO: 131789 - RNA, 22 nt, Human
gggagagagaaaggguggccac

SEQ ID NO: 131790 - RNA, 23 nt, Human
ccacccacuuaguccacucugag

SEQ ID NO: 131791 - RNA, 20 nt, Human
gcucuagcccuuccucucca

SEQ ID NO: 131792 - RNA, 26 nt, Human
caaugccaugaaccaguguccuguuc

SEQ ID NO: 131793 - RNA, 26 nt, Human
ggaagacuuggcuuuacguacuccca

SEQ ID NO: 131794 - RNA, 23 nt, Human
gugcagcccagacucuuccuagc

SEQ ID NO: 131795 - RNA, 27 nt, Human
uugcucaggcuggucucaaacuccuga

SEQ ID NO: 131796 - RNA, 21 nt, Human
cugggcuuuguuaugcuguaa

SEQ ID NO: 131797 - RNA, 19 nt, Human
gaccagacuggaaagugga

SEQ ID NO: 131798 - RNA, 27 nt, Human
aacugauucagaaacugacuuggggaa

SEQ ID NO: 131799 - RNA, 19 nt, Human
gcgacucccaacucagccu

SEQ ID NO: 131800 - RNA, 22 nt, Human
cuuuuuaaacucuaugcuccga

SEQ ID NO: 131801 - RNA, 22 nt, Human
ugcagugagcuaugaugaugcc

SEQ ID NO: 131802 - RNA, 22 nt, Human
gaucuuagaucccaggugguua

SEQ ID NO: 131803 - RNA, 23 nt, Human
uagcaagugaccagaaucugcca

SEQ ID NO: 131804 - RNA, 22 nt, Human
gggcucuccagcgaucuuccca

SEQ ID NO: 131805 - RNA, 22 nt, Human
uggcggcggggcuggggccacu

SEQ ID NO: 131806 - RNA, 26 nt, Human
gccuguaaucccagauacucaggagg

SEQ ID NO: 131807 - RNA, 23 nt, Human
acaacucucucccuuaccuguuu

SEQ ID NO: 131808 - RNA, 25 nt, Human
ugacuucugucugagcuaagcuggc

SEQ ID NO: 131809 - RNA, 22 nt, Human
aggcugaggugggaaaaugacu

SEQ ID NO: 131810 - RNA, 22 nt, Human
cccaaagggcacauuucuggau

SEQ ID NO: 131811 - RNA, 25 nt, Human
ggccucgggggucucagagccgccu

SEQ ID NO: 131812 - RNA, 26 nt, Human
gggagcgaagccagaggaucccuaca

SEQ ID NO: 131813 - RNA, 22 nt, Human
agcaagaagccagcuuuugggg

SEQ ID NO: 131814 - RNA, 22 nt, Human
uguggaccccgaguuccaccag

SEQ ID NO: 131815 - RNA, 20 nt, Human
cacuccugccucccagccca

SEQ ID NO: 131816 - RNA, 22 nt, Human
ccaacauagugaaaccccaucu

SEQ ID NO: 131817 - RNA, 27 nt, Human
uccucuuaaugugcagcaaaagcaggc

SEQ ID NO: 131818 - RNA, 25 nt, Human
gucacccaggcgggaguggugcaau

SEQ ID NO: 131819 - RNA, 21 nt, Human
acucacugaagcuucgauuuc

SEQ ID NO: 131820 - RNA, 23 nt, Human
auauguuccuaaauggagcacag

SEQ ID NO: 131821 - RNA, 26 nt, Human
uuaagacugauuuuaauagggaauau

SEQ ID NO: 131822 - RNA, 22 nt, Human
ugccgacaucccagagcugggc

SEQ ID NO: 131823 - RNA, 22 nt, Human
uccuggugccuccaucagacuc

SEQ ID NO: 131824 - RNA, 20 nt, Human
aaugaacacaccacucugag

SEQ ID NO: 131825 - RNA, 20 nt, Human
agaugagcucgaacacugcc

SEQ ID NO: 131826 - RNA, 21 nt, Human
ucaaauuuguuccuguaacuc

SEQ ID NO: 131827 - RNA, 24 nt, Human
gguguucaaggccagccugggcaa

SEQ ID NO: 131828 - RNA, 24 nt, Human
aaguuucaguauuagaugcacuua

SEQ ID NO: 131829 - RNA, 20 nt, Human
gaugccagcuucucucucca

SEQ ID NO: 131830 - RNA, 24 nt, Human
gucuuuagagccaccagaucucuc

SEQ ID NO: 131831 - RNA, 23 nt, Human
gcccuucugucuggccagcugcc

SEQ ID NO: 131832 - RNA, 27 nt, Human
uuccaauacgauuuucuguugcaccuu

SEQ ID NO: 131833 - RNA, 31 nt, Human
cucucucuaccugugacaaaauggaaagcug

SEQ ID NO: 131834 - RNA, 26 nt, Human
aucagagucaucagcaaacuguccaa

SEQ ID NO: 131835 - RNA, 27 nt, Human
uccccuccugcugcucuggagugcaag

SEQ ID NO: 131836 - RNA, 25 nt, Human
gggcaguacaguggcuucaagaguc

SEQ ID NO: 131837 - RNA, 27 nt, Human
ccucccucagcaccugcagugcagcca

SEQ ID NO: 131838 - RNA, 27 nt, Human
ugggugaccccucaccccagaagcagc

SEQ ID NO: 131839 - RNA, 20 nt, Human
uaacucauaaucuauaaaca

SEQ ID NO: 131840 - RNA, 20 nt, Human
aaauguucuaccucugcacu

SEQ ID NO: 131841 - RNA, 27 nt, Human
uccuccaggaccucagcugcacccauu

SEQ ID NO: 131842 - RNA, 17 nt, Human
caaaggagagucacaga

SEQ ID NO: 131843 - RNA, 27 nt, Human
cagggccuagaucuccucuccuccucc

SEQ ID NO: 131844 - RNA, 28 nt, Human
aaggcucaucuugagaagcaggcggguu

SEQ ID NO: 131845 - RNA, 25 nt, Human
aagugcagguuaugcaagucgccag

SEQ ID NO: 131846 - RNA, 22 nt, Human
auaguuucuauugcuaccucuu

SEQ ID NO: 131847 - RNA, 28 nt, Human
cauugcacagauggggaaacugaggcuu

SEQ ID NO: 131848 - RNA, 22 nt, Human
gcuccaaaggccagcaggcugg

SEQ ID NO: 131849 - RNA, 20 nt, Human
ccuggcuaauuuuuguacuu

SEQ ID NO: 131850 - RNA, 19 nt, Human
gagcugcugaggagccagg

SEQ ID NO: 131851 - RNA, 22 nt, Human
cccuccagguccucagaguuug

SEQ ID NO: 131852 - RNA, 23 nt, Human
acccaugaaaaacaagucagaga

SEQ ID NO: 131853 - RNA, 23 nt, Human
uggucccaggacaggaaugcggu

SEQ ID NO: 131854 - RNA, 21 nt, Human
auucuccagaccaaagcaauc

SEQ ID NO: 131855 - RNA, 21 nt, Human
uccagccugggcaacagagcu

SEQ ID NO: 131856 - RNA, 23 nt, Human
gcaaacaucagccuccacucucc

SEQ ID NO: 131857 - RNA, 20 nt, Human
gucuugagcccuagccugag

SEQ ID NO: 131858 - RNA, 26 nt, Human
gucagacuugaucacugacaccccgu

SEQ ID NO: 131859 - RNA, 22 nt, Human
uccgaguagcugggauuacagg

SEQ ID NO: 131860 - RNA, 22 nt, Human
ucugaguagcugggauuauagg

SEQ ID NO: 131861 - RNA, 21 nt, Human
ccaagagaagggcuuacaggc

SEQ ID NO: 131862 - RNA, 25 nt, Human
uuguuugggagagugcaguaguaau

SEQ ID NO: 131863 - RNA, 23 nt, Human
uggguauccccugccuccugcca

SEQ ID NO: 131864 - RNA, 22 nt, Human
gggugggaagagaggaggccag

SEQ ID NO: 131865 - RNA, 22 nt, Human
ugauuacuuguuuuauauuuca

SEQ ID NO: 131866 - RNA, 22 nt, Human
gguaaccucugccucccagguu

SEQ ID NO: 131867 - RNA, 22 nt, Human
ccccaguuuuucagucuguuga

SEQ ID NO: 131868 - RNA, 24 nt, Human
caagcauggcccugccucuggcgc

SEQ ID NO: 131869 - RNA, 22 nt, Human
cccaccgugggcagugccaccc

SEQ ID NO: 131870 - RNA, 22 nt, Human
gcguacuaugagcacauucacc

SEQ ID NO: 131871 - RNA, 22 nt, Human
cagcugagccacagucccagaa

SEQ ID NO: 131872 - RNA, 27 nt, Human
ggcucgcggcuccugaccaauggggaa

SEQ ID NO: 131873 - RNA, 25 nt, Human
gaaugcaaacaggcuucccuuuuuc

SEQ ID NO: 131874 - RNA, 23 nt, Human
gucacccagacuggaaugcagug

SEQ ID NO: 131875 - RNA, 21 nt, Human
aaucagcuuggauuggugcca

SEQ ID NO: 131876 - RNA, 21 nt, Human
ugccuucagaaucugacgaga

SEQ ID NO: 131877 - RNA, 20 nt, Human
gagaaguggcuugacaauca

SEQ ID NO: 131878 - RNA, 22 nt, Human
ccgcucccaccaccgcuaccac

SEQ ID NO: 131879 - RNA, 22 nt, Human
ucuuccuuccucugcuugucuc

SEQ ID NO: 131880 - RNA, 22 nt, Human
cuacuuuuaaaagacuuaaggu

SEQ ID NO: 131881 - RNA, 27 nt, Human
uacugccugcaggaacuccccacccca

SEQ ID NO: 131882 - RNA, 25 nt, Human
cacagcagcauccacccagccuggg

SEQ ID NO: 131883 - RNA, 21 nt, Human
gccccucucucagccucagug

SEQ ID NO: 131884 - RNA, 24 nt, Human
ccucaucagucaugcuccuccucc

SEQ ID NO: 131885 - RNA, 25 nt, Human
uuggagcuggugugcaguguccuga

SEQ ID NO: 131886 - RNA, 21 nt, Human
cugagagcugggcagggggga

SEQ ID NO: 131887 - RNA, 20 nt, Human
accccuuccuggaucacucc

SEQ ID NO: 131888 - RNA, 21 nt, Human
agaggaaauccucagcaaagg

SEQ ID NO: 131889 - RNA, 22 nt, Human
aacugcacuaugauuugcuuua

SEQ ID NO: 131890 - RNA, 21 nt, Human
uuuuaaaaugcgauuuuucug

SEQ ID NO: 131891 - RNA, 26 nt, Human
aauuugugcuuaacugucuucacuau

SEQ ID NO: 131892 - RNA, 24 nt, Human
gggaagggaagggcuuuucuccac

SEQ ID NO: 131893 - RNA, 22 nt, Human
ucaugccacugcacuccggccu

SEQ ID NO: 131894 - RNA, 22 nt, Human
ucaguaaugcaagggcauuuca

SEQ ID NO: 131895 - RNA, 22 nt, Human
cuucagaaacuuuuucuaaauu

SEQ ID NO: 131896 - RNA, 27 nt, Human
ccugcacagcuaaguguggagcuggac

SEQ ID NO: 131897 - RNA, 24 nt, Human
gcugguggccgucuccacucccua

SEQ ID NO: 131898 - RNA, 23 nt, Human
acugcaucacugcacuccagccu

SEQ ID NO: 131899 - RNA, 27 nt, Human
ugaccaacugaaagggaaaucuucauc

SEQ ID NO: 131900 - RNA, 23 nt, Human
gugaucuccccucacacuuugcc

SEQ ID NO: 131901 - RNA, 22 nt, Human
cacugcaauccagccugggcaa

SEQ ID NO: 131902 - RNA, 24 nt, Human
ccuccuccucugggcacagggugu

SEQ ID NO: 131903 - RNA, 21 nt, Human
acacagccaaggggaugcucu

SEQ ID NO: 131904 - RNA, 27 nt, Human
cagauacaccuaagaagcuuaggggca

SEQ ID NO: 131905 - RNA, 24 nt, Human
aaauuaaguucugacuugcucacu

SEQ ID NO: 131906 - RNA, 22 nt, Human
caggaguucugaagcugacagc

SEQ ID NO: 131907 - RNA, 21 nt, Human
acccccucccugucaucaccc

SEQ ID NO: 131908 - RNA, 26 nt, Human
cacauacuuaacguuucuauauuucu

SEQ ID NO: 131909 - RNA, 22 nt, Human
guugcccacacugggggccaga

SEQ ID NO: 131910 - RNA, 18 nt, Human
uguaacuucuaugaucau

SEQ ID NO: 131911 - RNA, 25 nt, Human
accuguacugucaggugcacuuuga

SEQ ID NO: 131912 - RNA, 22 nt, Human
aggagugaucauggcuaccuca

SEQ ID NO: 131913 - RNA, 22 nt, Human
agcagcaaaugaaacaaaaaug

SEQ ID NO: 131914 - RNA, 25 nt, Human
ucugccccacugccagccugagugg

SEQ ID NO: 131915 - RNA, 27 nt, Human
caucgccaaagaggacuucacagcccu

SEQ ID NO: 131916 - RNA, 18 nt, Human
accagcagaaaugccuua

SEQ ID NO: 131917 - RNA, 20 nt, Human
gccaacgccuccugucccca

SEQ ID NO: 131918 - RNA, 19 nt, Human
agaaccucuccuucaggag

SEQ ID NO: 131919 - RNA, 21 nt, Human
uacaguaucagacacgaucau

SEQ ID NO: 131920 - RNA, 23 nt, Human
ugccuguaaugccagcuacucgg

SEQ ID NO: 131921 - RNA, 20 nt, Human
aagaccuguggcugaaggaa

SEQ ID NO: 131922 - RNA, 25 nt, Human
ggcuucuuggcuucucuggugaugg

SEQ ID NO: 131923 - RNA, 23 nt, Human
ucuccgcucgagaaucugaaggu

SEQ ID NO: 131924 - RNA, 21 nt, Human
gcaagccccagccccgaggac

SEQ ID NO: 131925 - RNA, 27 nt, Human
uucugaccuacuauuuuuaaaauuccu

SEQ ID NO: 131926 - RNA, 22 nt, Human
gauuccccuucccacuccagca

SEQ ID NO: 131927 - RNA, 21 nt, Human
uccugacuugaacauagggug

SEQ ID NO: 131928 - RNA, 22 nt, Human
gguuaacacugguugacuugaa

SEQ ID NO: 131929 - RNA, 21 nt, Human
cuucccucagaccauaacuca

SEQ ID NO: 131930 - RNA, 22 nt, Human
aaaaaacaaaacgaaagugcuu

SEQ ID NO: 131931 - RNA, 27 nt, Human
uggucauugggcaguguuaaugcugaa

SEQ ID NO: 131932 - RNA, 20 nt, Human
cccuauguugcccaggcugg

SEQ ID NO: 131933 - RNA, 20 nt, Human
cagaaguccagaagggucau

SEQ ID NO: 131934 - RNA, 22 nt, Human
gcuucucugcugggaucucgcu

SEQ ID NO: 131935 - RNA, 21 nt, Human
cagccuaugucuuuauauugu

SEQ ID NO: 131936 - RNA, 28 nt, Human
cccaaaugacuccuccccuucguuggcc

SEQ ID NO: 131937 - RNA, 20 nt, Human
uagggagaugaguugcaguu

SEQ ID NO: 131938 - RNA, 32 nt, Human
ccugccuuuuucaaauaucccugccuuuuccc

SEQ ID NO: 131939 - RNA, 31 nt, Human
guggggucagggcugagaggagaaggaggga

SEQ ID NO: 131940 - RNA, 21 nt, Human
caccuguaaucccagcacuuu

SEQ ID NO: 131941 - RNA, 22 nt, Human
uguugccaggcuggagugcagu

SEQ ID NO: 131942 - RNA, 24 nt, Human
gaucugacuccugcagacucuucc

SEQ ID NO: 131943 - RNA, 22 nt, Human
aucccuggccuuaggacacagg

SEQ ID NO: 131944 - RNA, 26 nt, Human
ggagcuggaggcggaggcagcugggg

SEQ ID NO: 131945 - RNA, 22 nt, Human
cugaggcagguggaucacugga

SEQ ID NO: 131946 - RNA, 21 nt, Human
aaccucaacugccuacuccaa

SEQ ID NO: 131947 - RNA, 22 nt, Human
uggcucaugccgauaaucccag

SEQ ID NO: 131948 - RNA, 25 nt, Human
uugagaucagccugggcaaugugau

SEQ ID NO: 131949 - RNA, 22 nt, Human
ccaggaguuggggcuccagaac

SEQ ID NO: 131950 - RNA, 31 nt, Human
ccaagugcuggcccacccaguccaugcucca

SEQ ID NO: 131951 - RNA, 27 nt, Human
ugccagaccucaaaacgacgggggcag

SEQ ID NO: 131952 - RNA, 21 nt, Human
acucaaggcuccucuggccca

SEQ ID NO: 131953 - RNA, 26 nt, Human
uucuccucacaaggaggugaggcugg

SEQ ID NO: 131954 - RNA, 28 nt, Human
gccaggugugaauccugagguccaugga

SEQ ID NO: 131955 - RNA, 20 nt, Human
aggaaauguucucagaugcu

SEQ ID NO: 131956 - RNA, 22 nt, Human
acugguuugacucuguccaacu

SEQ ID NO: 131957 - RNA, 31 nt, Human
auuuggucuuuaagugaacugucuuaaauga

SEQ ID NO: 131958 - RNA, 28 nt, Human
ccaggccuggccucgccugccuuucugc

SEQ ID NO: 131959 - RNA, 29 nt, Human
caggauucagaucagagguucgacugugg

SEQ ID NO: 131960 - RNA, 27 nt, Human
cacugcaccuccaccuuccgggcucaa

SEQ ID NO: 131961 - RNA, 29 nt, Human
ccccgagucccaugacaccgcuucuccuc

SEQ ID NO: 131962 - RNA, 24 nt, Human
ugccuccagggcuggacugaggcc

SEQ ID NO: 131963 - RNA, 21 nt, Human
ccccuugguucucauaacucu

SEQ ID NO: 131964 - RNA, 20 nt, Human
cccugcccucuuugaccugg

SEQ ID NO: 131965 - RNA, 26 nt, Human
aacuaauucuggugcucaggcugggc

SEQ ID NO: 131966 - RNA, 27 nt, Human
gcagagcugugggagcaucggcacccc

SEQ ID NO: 131967 - RNA, 24 nt, Human
uccuacuugcgacaagguggacuu

SEQ ID NO: 131968 - RNA, 23 nt, Human
cuuuuauaccugcucuuguucua

SEQ ID NO: 131969 - RNA, 28 nt, Human
gccuuuccgguccuuccugggcaaaucu

SEQ ID NO: 131970 - RNA, 25 nt, Human
uccucagaucccgggaacgucagca

SEQ ID NO: 131971 - RNA, 24 nt, Human
gaguuggagagcagacugggcaac

SEQ ID NO: 131972 - RNA, 25 nt, Human
ggaucuucaguucugcccuugcugc

SEQ ID NO: 131973 - RNA, 23 nt, Human
cucagucauuagacuccuccucc

SEQ ID NO: 131974 - RNA, 22 nt, Human
acggggguuucaccauguuggc

SEQ ID NO: 131975 - RNA, 23 nt, Human
ucugauggagugcacuucgcacg

SEQ ID NO: 131976 - RNA, 17 nt, Human
gaacaacaguggacuuu

SEQ ID NO: 131977 - RNA, 19 nt, Human
aguggugggguagagggug

SEQ ID NO: 131978 - RNA, 28 nt, Human
cugucuuugguauuauaguucaucuucc

SEQ ID NO: 131979 - RNA, 18 nt, Human
gacagaugccuggugagc

SEQ ID NO: 131980 - RNA, 23 nt, Human
gucucugagacccaucuccugcc

SEQ ID NO: 131981 - RNA, 25 nt, Human
cuguggguagacacacaugaagucc

SEQ ID NO: 131982 - RNA, 26 nt, Human
cucuccuccacuucauauuucauacc

SEQ ID NO: 131983 - RNA, 17 nt, Human
gccaccaucuuaccuca

SEQ ID NO: 131984 - RNA, 25 nt, Human
aaagagaguuuuuauuaaaugaacc

SEQ ID NO: 131985 - RNA, 21 nt, Human
ggagaagaaaaaaggugcugu

SEQ ID NO: 131986 - RNA, 24 nt, Human
cuuucauuccuucagauuuggcuu

SEQ ID NO: 131987 - RNA, 25 nt, Human
cccucugucccucugacccugcacu

SEQ ID NO: 131988 - RNA, 25 nt, Human
cucauuagugaagguggcuuuugcu

SEQ ID NO: 131989 - RNA, 22 nt, Human
uccacacacauaauggcagcuc

SEQ ID NO: 131990 - RNA, 19 nt, Human
gcaacuguuucaacuuguu

SEQ ID NO: 131991 - RNA, 22 nt, Human
gaaggcugagaggaguaggaag

SEQ ID NO: 131992 - RNA, 25 nt, Human
uuucauguaugcauuggucuugccu

SEQ ID NO: 131993 - RNA, 23 nt, Human
uuaccugcaggcugagccacucu

SEQ ID NO: 131994 - RNA, 22 nt, Human
accacucuguggccagccuggc

SEQ ID NO: 131995 - RNA, 26 nt, Human
cucagccccagcuuaucuccuccucc

SEQ ID NO: 131996 - RNA, 23 nt, Human
ugccaugaaaagguuauguaaua

SEQ ID NO: 131997 - RNA, 24 nt, Human
agcucuguaaccaguccuguccca

SEQ ID NO: 131998 - RNA, 26 nt, Human
cucagcuucccagaaugccgagauga

SEQ ID NO: 131999 - RNA, 27 nt, Human
gccagugcgagcccagagggcccgaag

SEQ ID NO: 132000 - RNA, 23 nt, Human
uccuucuggcagggacucuuauu

SEQ ID NO: 132001 - RNA, 22 nt, Human
ugccaggagccucuccccucca

SEQ ID NO: 132002 - RNA, 19 nt, Human
ggccucggcgacccucucc

SEQ ID NO: 132003 - RNA, 24 nt, Human
uguacuuuagacaugaaugcaacu

SEQ ID NO: 132004 - RNA, 24 nt, Human
ucugcccucauagaguugauuguc

SEQ ID NO: 132005 - RNA, 20 nt, Human
cuggccaggguggagcauug

SEQ ID NO: 132006 - RNA, 19 nt, Human
cggccuauccauuacuggg

SEQ ID NO: 132007 - RNA, 20 nt, Human
accuucagucugaccccugc

SEQ ID NO: 132008 - RNA, 26 nt, Human
agucauuccuuccaucuuccuugcag

SEQ ID NO: 132009 - RNA, 16 nt, Human
acugccucuguugugu

SEQ ID NO: 132010 - RNA, 26 nt, Human
gcauuuucaccugagguuucccugca

SEQ ID NO: 132011 - RNA, 21 nt, Human
ugugaucaauagauuguaaua

SEQ ID NO: 132012 - RNA, 22 nt, Human
ccuauuuucucccuuauuaucc

SEQ ID NO: 132013 - RNA, 20 nt, Human
uuaaaaaagcaccguggaga

SEQ ID NO: 132014 - RNA, 21 nt, Human
uuugaacuuccgucuuuagcu

SEQ ID NO: 132015 - RNA, 21 nt, Human
gcucacugcaaacucugccuc

SEQ ID NO: 132016 - RNA, 20 nt, Human
ucuuuuccuuuuucuuccug

SEQ ID NO: 132017 - RNA, 20 nt, Human
cugccucuugugccucuggc

SEQ ID NO: 132018 - RNA, 19 nt, Human
uggacuuuggcuucuuugc

SEQ ID NO: 132019 - RNA, 27 nt, Human
ucgagacccaaacccccaaaauccaaa

SEQ ID NO: 132020 - RNA, 21 nt, Human
aucuauaucuacuuuguguuu

SEQ ID NO: 132021 - RNA, 21 nt, Human
ugagaccaagaauuggcaaau

SEQ ID NO: 132022 - RNA, 22 nt, Human
ugcuugauccugggaggcagag

SEQ ID NO: 132023 - RNA, 23 nt, Human
cccuuugcauucuuucuggaccu

SEQ ID NO: 132024 - RNA, 24 nt, Human
uaagggguaggaaggugcuguggg

SEQ ID NO: 132025 - RNA, 23 nt, Human
gaugcugggggcagugcuuucca

SEQ ID NO: 132026 - RNA, 22 nt, Human
gggauuacagaugugagccacc

SEQ ID NO: 132027 - RNA, 21 nt, Human
uuucuuucuuuauuuugagau

SEQ ID NO: 132028 - RNA, 23 nt, Human
agguccagcgcucccucacagaa

SEQ ID NO: 132029 - RNA, 23 nt, Human
guggcucucgccuguaaucucag

SEQ ID NO: 132030 - RNA, 22 nt, Human
ugcucagugcaaccucugccuc

SEQ ID NO: 132031 - RNA, 23 nt, Human
ggauggauccacugugggugggg

SEQ ID NO: 132032 - RNA, 26 nt, Human
aaccauggucggaaaacaugcuacac

SEQ ID NO: 132033 - RNA, 26 nt, Human
acugauuuuauuaaaucagagucuuu

SEQ ID NO: 132034 - RNA, 20 nt, Human
uacauuccaucacacccagc

SEQ ID NO: 132035 - RNA, 27 nt, Human
aauacuggucucuuuccaaagcauuuu

SEQ ID NO: 132036 - RNA, 20 nt, Human
uggguuccggugauucucau

SEQ ID NO: 132037 - RNA, 20 nt, Human
cacaauuuccacacugugaa

SEQ ID NO: 132038 - RNA, 24 nt, Human
agcacuauuuauuuuuaaugcuuc

SEQ ID NO: 132039 - RNA, 18 nt, Human
ggcauccuggaugauuuc

SEQ ID NO: 132040 - RNA, 19 nt, Human
aguuuucuagaaguggaag

SEQ ID NO: 132041 - RNA, 22 nt, Human
uuuuuguagacuuuaauagaga

SEQ ID NO: 132042 - RNA, 27 nt, Human
ccccgagcccucuccauggaggcagcc

SEQ ID NO: 132043 - RNA, 25 nt, Human
cugcaccaguccugccuguccuucu

SEQ ID NO: 132044 - RNA, 24 nt, Human
acacgccgcgaccuacagcucuuu

SEQ ID NO: 132045 - RNA, 22 nt, Human
uuuuugggggaugacauucagu

SEQ ID NO: 132046 - RNA, 19 nt, Human
cugucucuuccugccugug

SEQ ID NO: 132047 - RNA, 19 nt, Human
uuaagaguggauuacaggc

SEQ ID NO: 132048 - RNA, 21 nt, Human
aacagcauuuuuaaaaaccga

SEQ ID NO: 132049 - RNA, 21 nt, Human
auuucaggugagucaggguug

SEQ ID NO: 132050 - RNA, 27 nt, Human
ucaaauaccaccccaacccacucccug

SEQ ID NO: 132051 - RNA, 20 nt, Human
ucagguggaggcaacagggc

SEQ ID NO: 132052 - RNA, 22 nt, Human
uuugcauccuguccuccagcca

SEQ ID NO: 132053 - RNA, 24 nt, Human
uccauaaagcacauuuuaaggaac

SEQ ID NO: 132054 - RNA, 23 nt, Human
gccggggucugagucucugcugg

SEQ ID NO: 132055 - RNA, 22 nt, Human
agacuccugggcuuaagggauc

SEQ ID NO: 132056 - RNA, 23 nt, Human
gggccucuuuaccauagcuuaag

SEQ ID NO: 132057 - RNA, 20 nt, Human
auugccuguauuucuaccuc

SEQ ID NO: 132058 - RNA, 20 nt, Human
gcuuuuguguucauuuuuua

SEQ ID NO: 132059 - RNA, 21 nt, Human
ugcagcugcugcgccuguguc

SEQ ID NO: 132060 - RNA, 22 nt, Human
ugggaggucaaggcugcaguga

SEQ ID NO: 132061 - RNA, 22 nt, Human
uaggaggucgaggcugcaguga

SEQ ID NO: 132062 - RNA, 22 nt, Human
caggagguugaggcugcaguga

SEQ ID NO: 132063 - RNA, 17 nt, Human
cucagagggcagguccu

SEQ ID NO: 132064 - RNA, 25 nt, Human
uugcccagucuucagcggagcaguu

SEQ ID NO: 132065 - RNA, 22 nt, Human
acugcagccucgaacuccuggg

SEQ ID NO: 132066 - RNA, 19 nt, Human
aacaacugaggcucaggga

SEQ ID NO: 132067 - RNA, 22 nt, Human
acuuagggcaucaggaacagug

SEQ ID NO: 132068 - RNA, 24 nt, Human
cccugcucuuccugcuugcuggca

SEQ ID NO: 132069 - RNA, 22 nt, Human
uuuacacccuguagaauugugg

SEQ ID NO: 132070 - RNA, 27 nt, Human
uguggaacuuggaaaaacaagaguucu

SEQ ID NO: 132071 - RNA, 26 nt, Human
gacuccuguccccuugguuucugugu

SEQ ID NO: 132072 - RNA, 22 nt, Human
aaaugccccacauuuuacuaca

SEQ ID NO: 132073 - RNA, 27 nt, Human
cucaaagcuccuaggaaucauucucga

SEQ ID NO: 132074 - RNA, 21 nt, Human
cccacaucucccaggcugcuu

SEQ ID NO: 132075 - RNA, 26 nt, Human
cucuccucuccacggucgccugugcc

SEQ ID NO: 132076 - RNA, 22 nt, Human
ccgccuccuggguucaagcaag

SEQ ID NO: 132077 - RNA, 27 nt, Human
cuccuguuuuuauuaucaaaaaggaca

SEQ ID NO: 132078 - RNA, 22 nt, Human
ggaaagccucuuugcauuuaga

SEQ ID NO: 132079 - RNA, 21 nt, Human
gacaucccacgcaaagccaca

SEQ ID NO: 132080 - RNA, 26 nt, Human
gcuguuaaccauuugcaccucuaagu

SEQ ID NO: 132081 - RNA, 25 nt, Human
gacaugaauggggccauauucuucc

SEQ ID NO: 132082 - RNA, 23 nt, Human
uuggggaauguggguggcuuaga

SEQ ID NO: 132083 - RNA, 22 nt, Human
ugaguuucuuuuuaugaugauu

SEQ ID NO: 132084 - RNA, 26 nt, Human
aagcuaaacaccaguuucucaggagg

SEQ ID NO: 132085 - RNA, 22 nt, Human
agccucccaaaguguugggauu

SEQ ID NO: 132086 - RNA, 22 nt, Human
agccucucaaagugcugggauu

SEQ ID NO: 132087 - RNA, 20 nt, Human
ugcagugagccgagaucgcc

SEQ ID NO: 132088 - RNA, 24 nt, Human
uaauucauugagugaaauauuuua

SEQ ID NO: 132089 - RNA, 22 nt, Human
gccugcuguuuggaaaggguga

SEQ ID NO: 132090 - RNA, 27 nt, Human
auuugucugcuuuucuugcagcaucau

SEQ ID NO: 132091 - RNA, 22 nt, Human
cugaggcaggaggaucaguuga

SEQ ID NO: 132092 - RNA, 27 nt, Human
uuuggaguuugcacagcaaacauuuua

SEQ ID NO: 132093 - RNA, 31 nt, Human
gaugaauuaguugcugucacaaaaggaggga

SEQ ID NO: 132094 - RNA, 26 nt, Human
ggagcuacagggacagggagccauca

SEQ ID NO: 132095 - RNA, 27 nt, Human
gaggaagaagcugacuaagaaccagcc

SEQ ID NO: 132096 - RNA, 26 nt, Human
ccagcucuggcacagugguuccuggc

SEQ ID NO: 132097 - RNA, 15 nt, Human
augugggaaagcuuu

SEQ ID NO: 132098 - RNA, 21 nt, Human
cagugcaguuagccugagcuc

SEQ ID NO: 132099 - RNA, 22 nt, Human
gacuguuugucuuuccuagaga

SEQ ID NO: 132100 - RNA, 22 nt, Human
ucagcggaggccaaaucugaag

SEQ ID NO: 132101 - RNA, 23 nt, Human
cgccaaguuggagcuugcaguga

SEQ ID NO: 132102 - RNA, 27 nt, Human
acuaagcugcagggaaauaaaucggcu

SEQ ID NO: 132103 - RNA, 22 nt, Human
ucaggaugacgugcagaaaaau

SEQ ID NO: 132104 - RNA, 27 nt, Human
uugucucuaguaguguggccugugcca

SEQ ID NO: 132105 - RNA, 25 nt, Human
gcccaggcuggcgugcaguggugcg

SEQ ID NO: 132106 - RNA, 23 nt, Human
auaaagugcaauggggaaagcag

SEQ ID NO: 132107 - RNA, 14 nt, Human
agccccccaccucg

SEQ ID NO: 132108 - RNA, 21 nt, Human
acacacuggggccuaugagag

SEQ ID NO: 132109 - RNA, 16 nt, Human
cuucccuuuccaguga

SEQ ID NO: 132110 - RNA, 20 nt, Human
uggagcgagagggaggcagg

SEQ ID NO: 132111 - RNA, 21 nt, Human
ggaggcuggggaugggggugg

SEQ ID NO: 132112 - RNA, 20 nt, Human
ugcugcccagccacuccagg

SEQ ID NO: 132113 - RNA, 22 nt, Human
cccugcucugagcauucaggcc

SEQ ID NO: 132114 - RNA, 23 nt, Human
ccagggggaaagcccagcucucu

SEQ ID NO: 132115 - RNA, 19 nt, Human
ccuuuguccugaucguuuu

SEQ ID NO: 132116 - RNA, 27 nt, Human
uucaaaaccagcucccaugugcugaga

SEQ ID NO: 132117 - RNA, 29 nt, Human
cagaucugaucaagaguccggauuucuaa

SEQ ID NO: 132118 - RNA, 24 nt, Human
uuguaucccauuuuacugucuuuu

SEQ ID NO: 132119 - RNA, 25 nt, Human
gcuggcuccagccuggaaaccuguc

SEQ ID NO: 132120 - RNA, 21 nt, Human
auggaaaaauguaaaaggcag

SEQ ID NO: 132121 - RNA, 22 nt, Human
cgccuguaauuccagcauguug

SEQ ID NO: 132122 - RNA, 24 nt, Human
ugggagccaggaagguggggggug

SEQ ID NO: 132123 - RNA, 27 nt, Human
aagccagaagucacauuuuaccaauau

SEQ ID NO: 132124 - RNA, 23 nt, Human
cucaaagcaaacuaucauuccag

SEQ ID NO: 132125 - RNA, 26 nt, Human
cuuugggccuggugugguggcauagg

SEQ ID NO: 132126 - RNA, 24 nt, Human
ccgccugccuccacuccugccucc

SEQ ID NO: 132127 - RNA, 27 nt, Human
ccagguaagaccggauugaagcuuuga

SEQ ID NO: 132128 - RNA, 23 nt, Human
guaccuuuuugucucugcugaaa

SEQ ID NO: 132129 - RNA, 26 nt, Human
ccagaagagacaggagaucagagacc

SEQ ID NO: 132130 - RNA, 29 nt, Human
agcucacucugcaaccuccacuucccagg

SEQ ID NO: 132131 - RNA, 23 nt, Human
cuacagucuucauuuuagugcuu

SEQ ID NO: 132132 - RNA, 23 nt, Human
agagaagccucggguaacacuga

SEQ ID NO: 132133 - RNA, 23 nt, Human
ggagcuugaacuaggggaaaggc

SEQ ID NO: 132134 - RNA, 25 nt, Human
uccugcaggacucuaucccuggcuu

SEQ ID NO: 132135 - RNA, 24 nt, Human
uggggaggggaggguguaucuagc

SEQ ID NO: 132136 - RNA, 21 nt, Human
guucauuuuuuagcugucaac

SEQ ID NO: 132137 - RNA, 25 nt, Human
caauugcuucccuucuuaaacagua

SEQ ID NO: 132138 - RNA, 29 nt, Human
ggugggcugcagaacggggugggaacugg

SEQ ID NO: 132139 - RNA, 28 nt, Human
gaaguggaagggacaggagcacauaggu

SEQ ID NO: 132140 - RNA, 27 nt, Human
ucaagcgauucuucugcuucagucucc

SEQ ID NO: 132141 - RNA, 22 nt, Human
gaguaaaauggaaauaucucca

SEQ ID NO: 132142 - RNA, 23 nt, Human
gcuccccagauugcaguuggagu

SEQ ID NO: 132143 - RNA, 22 nt, Human
ugccgccuuccccaucacggag

SEQ ID NO: 132144 - RNA, 23 nt, Human
aaagguuucauguucacugugag

SEQ ID NO: 132145 - RNA, 24 nt, Human
guccugcagaagcagaagugcaau

SEQ ID NO: 132146 - RNA, 27 nt, Human
augagacagaucggauccaguuuccca

SEQ ID NO: 132147 - RNA, 28 nt, Human
agaaguaaacagauggcacuuugaaggg

SEQ ID NO: 132148 - RNA, 21 nt, Human
guucacugcaaugcuggacac

SEQ ID NO: 132149 - RNA, 27 nt, Human
ugcaucucauaccuuuaccucuggcca

SEQ ID NO: 132150 - RNA, 24 nt, Human
cacuaaucagaaaacugugcccaa

SEQ ID NO: 132151 - RNA, 22 nt, Human
ggaaggaauggggucuucuuga

SEQ ID NO: 132152 - RNA, 25 nt, Human
ggugagggcaggauggagaccaagg

SEQ ID NO: 132153 - RNA, 22 nt, Human
ccaucugaggcuuccucccugg

SEQ ID NO: 132154 - RNA, 21 nt, Human
gaacgcgguguguaacacugu

SEQ ID NO: 132155 - RNA, 30 nt, Human
uccucugacggcauccccaggaagggggag

SEQ ID NO: 132156 - RNA, 25 nt, Human
gugaacaaaccccgagggaggcccg

SEQ ID NO: 132157 - RNA, 26 nt, Human
accugagaguaguauaguagugcaaa

SEQ ID NO: 132158 - RNA, 28 nt, Human
gcauggggcagaggcuuccguguccucu

SEQ ID NO: 132159 - RNA, 27 nt, Human
uggguuuaagcgauucuccugccucag

SEQ ID NO: 132160 - RNA, 22 nt, Human
gggagaauucuuacauguuuuc

SEQ ID NO: 132161 - RNA, 24 nt, Human
ccaguccuucacuuaucaauaugc

SEQ ID NO: 132162 - RNA, 19 nt, Human
caaaacugaaccagaugaa

SEQ ID NO: 132163 - RNA, 27 nt, Human
gagaagggagagcgagcuuaggaccgc

SEQ ID NO: 132164 - RNA, 25 nt, Human
ugcuucuuacaggaacaguuaccca

SEQ ID NO: 132165 - RNA, 25 nt, Human
gugauugcaaagguguuuauguacu

SEQ ID NO: 132166 - RNA, 24 nt, Human
cauguggccccuguggcucugcug

SEQ ID NO: 132167 - RNA, 27 nt, Human
ccugccuggucuccugcccccacaccu

SEQ ID NO: 132168 - RNA, 30 nt, Human
uguccggccagccgcuggagucguuaggug

SEQ ID NO: 132169 - RNA, 23 nt, Human
uggaggccuucacagguaauaca

SEQ ID NO: 132170 - RNA, 19 nt, Human
uaauguagaccuguuuggg

SEQ ID NO: 132171 - RNA, 27 nt, Human
cugccgucuacauccuccugugcugcu

SEQ ID NO: 132172 - RNA, 22 nt, Human
cucggccucccaaagcacuggg

SEQ ID NO: 132173 - RNA, 21 nt, Human
ggggugagggcgguguguugu

SEQ ID NO: 132174 - RNA, 30 nt, Human
guggcauuuuucucccuuucuaaaaugaaa

SEQ ID NO: 132175 - RNA, 24 nt, Human
cacugcugggcaucauuugagaug

SEQ ID NO: 132176 - RNA, 20 nt, Human
gucuucaugugaccugcagu

SEQ ID NO: 132177 - RNA, 20 nt, Human
acgauggaggcaggagcugc

SEQ ID NO: 132178 - RNA, 20 nt, Human
ggucuucuuggcagcuuaac

SEQ ID NO: 132179 - RNA, 21 nt, Human
gggcaugacauccuuucuuuu

SEQ ID NO: 132180 - RNA, 24 nt, Human
ccggggagacggagguugcaguga

SEQ ID NO: 132181 - RNA, 20 nt, Human
cacugccucccacccugugu

SEQ ID NO: 132182 - RNA, 22 nt, Human
gcuggccuggaugggcuucacu

SEQ ID NO: 132183 - RNA, 26 nt, Human
uaacauccuugccuucccauuuaucc

SEQ ID NO: 132184 - RNA, 28 nt, Human
cugugcaaccuuacuaugugcaauauuu

SEQ ID NO: 132185 - RNA, 22 nt, Human
aguuauuuuauuuuaagggaau

SEQ ID NO: 132186 - RNA, 20 nt, Human
gagcgagacugucucaaaac

SEQ ID NO: 132187 - RNA, 20 nt, Human
ccgccccugccugccaugua

SEQ ID NO: 132188 - RNA, 22 nt, Human
gccuaugaucccagcacuuugg

SEQ ID NO: 132189 - RNA, 21 nt, Human
ucacaguccgugagucuucca

SEQ ID NO: 132190 - RNA, 27 nt, Human
ccagagcccaccuccccaacaugugaa

SEQ ID NO: 132191 - RNA, 27 nt, Human
gacuauucuugauguaaaaucuuguca

SEQ ID NO: 132192 - RNA, 25 nt, Human
aacuauacugccuugugaugccucc

SEQ ID NO: 132193 - RNA, 21 nt, Human
ugggcuaucuuagcuaacuua

SEQ ID NO: 132194 - RNA, 22 nt, Human
ccacuggacuccagccugcgug

SEQ ID NO: 132195 - RNA, 21 nt, Human
gcaacagaaguugaagcacaa

SEQ ID NO: 132196 - RNA, 18 nt, Human
ucuuccuuauuucacuga

SEQ ID NO: 132197 - RNA, 25 nt, Human
gccucauggaugaaagacuuguagu

SEQ ID NO: 132198 - RNA, 25 nt, Human
cccucccucuuggugaauuauuaca

SEQ ID NO: 132199 - RNA, 27 nt, Human
gccucaaacuccugggcucaagcgauc

SEQ ID NO: 132200 - RNA, 20 nt, Human
ugcccaggaucgugugugug

SEQ ID NO: 132201 - RNA, 26 nt, Human
ccuccaucccccucugucugcccuca

SEQ ID NO: 132202 - RNA, 26 nt, Human
uaggagagaauguuucagaacucccu

SEQ ID NO: 132203 - RNA, 26 nt, Human
cagggcgcaaacccaggacaucugug

SEQ ID NO: 132204 - RNA, 20 nt, Human
cacgcgguaaaacaucaucu

SEQ ID NO: 132205 - RNA, 21 nt, Human
uucugugucccuaccagacac

SEQ ID NO: 132206 - RNA, 26 nt, Human
gggaagggaagggccaggccagaccc

SEQ ID NO: 132207 - RNA, 29 nt, Human
gucuuagggucaagugaucuuuaugggau

SEQ ID NO: 132208 - RNA, 22 nt, Human
uuguauuuggaggcucuucugu

SEQ ID NO: 132209 - RNA, 24 nt, Human
uuaaguccagugagcauuguggua

SEQ ID NO: 132210 - RNA, 26 nt, Human
cacacgccuucagguuugcucagggg

SEQ ID NO: 132211 - RNA, 28 nt, Human
cccccgugggcgaaaggcugcugcgguu

SEQ ID NO: 132212 - RNA, 26 nt, Human
guuccagguagugguuuugccuuucc

SEQ ID NO: 132213 - RNA, 24 nt, Human
guuuucuuuuuuaaauguuucuug

SEQ ID NO: 132214 - RNA, 20 nt, Human
aaaguauuugcuauaauaaa

SEQ ID NO: 132215 - RNA, 27 nt, Human
uguccccagacagugauggcccaaaau

SEQ ID NO: 132216 - RNA, 21 nt, Human
agcugugcaauuacugccugc

SEQ ID NO: 132217 - RNA, 18 nt, Human
aaaguuaaauaacaggga

SEQ ID NO: 132218 - RNA, 22 nt, Human
cuuaguggugcuugcagucaca

SEQ ID NO: 132219 - RNA, 20 nt, Human
uuuuagcuuucagcaacuga

SEQ ID NO: 132220 - RNA, 27 nt, Human
aggccagaauggaacgacuucaaagag

SEQ ID NO: 132221 - RNA, 22 nt, Human
ugcaaccuccgcaucccggguu

SEQ ID NO: 132222 - RNA, 25 nt, Human
ugauuaaucucaguauuaaaccaca

SEQ ID NO: 132223 - RNA, 20 nt, Human
cuucuuccaacuccuccucg

SEQ ID NO: 132224 - RNA, 27 nt, Human
ccaggagguggcguccagcaguccagg

SEQ ID NO: 132225 - RNA, 26 nt, Human
cagggaagaucugggggacagaggaa

SEQ ID NO: 132226 - RNA, 19 nt, Human
uucaguuuuacuuuuguau

SEQ ID NO: 132227 - RNA, 23 nt, Human
aguggguggaguggugcuuagag

SEQ ID NO: 132228 - RNA, 27 nt, Human
caauaaauuccugagauacauucuucc

SEQ ID NO: 132229 - RNA, 25 nt, Human
agagcaagaacauguggaucuuuga

SEQ ID NO: 132230 - RNA, 22 nt, Human
ccacugcccuccagccuaggug

SEQ ID NO: 132231 - RNA, 20 nt, Human
aaaaugcccuuuaacuuucu

SEQ ID NO: 132232 - RNA, 18 nt, Human
accugcugagacugcuga

SEQ ID NO: 132233 - RNA, 18 nt, Human
ggcuaugauccuagcugg

SEQ ID NO: 132234 - RNA, 22 nt, Human
aucgcuugaacccgggaggcgg

SEQ ID NO: 132235 - RNA, 22 nt, Human
augaucuccguucacugcaauc

SEQ ID NO: 132236 - RNA, 26 nt, Human
uguaaaccagagagcugcugggggau

SEQ ID NO: 132237 - RNA, 18 nt, Human
ugcauuccagccuaggca

SEQ ID NO: 132238 - RNA, 22 nt, Human
uggcucaggccuguaaucccag

SEQ ID NO: 132239 - RNA, 24 nt, Human
auggacucugugacauggucaggu

SEQ ID NO: 132240 - RNA, 26 nt, Human
uccuuugauagaaaggaauuuuaaau

SEQ ID NO: 132241 - RNA, 20 nt, Human
gacuccugccaccagcaucc

SEQ ID NO: 132242 - RNA, 21 nt, Human
acuagcacagcaucacuucua

SEQ ID NO: 132243 - RNA, 26 nt, Human
ccuugcuucggccucaguuaagccuu

SEQ ID NO: 132244 - RNA, 23 nt, Human
accucuagcuuucuuccuacccc

SEQ ID NO: 132245 - RNA, 22 nt, Human
ggaggcugagacagguggauca

SEQ ID NO: 132246 - RNA, 20 nt, Human
cuaagcugacauuggaacau

SEQ ID NO: 132247 - RNA, 24 nt, Human
gggcucccuccuuaccgcaggagc

SEQ ID NO: 132248 - RNA, 23 nt, Human
ggaccgguaggggccggagcagc

SEQ ID NO: 132249 - RNA, 21 nt, Human
gcaccuccuccuccuucugca

SEQ ID NO: 132250 - RNA, 21 nt, Human
ggccacaccccagacuccagg

SEQ ID NO: 132251 - RNA, 23 nt, Human
gcaguggugguagcuacacuggg

SEQ ID NO: 132252 - RNA, 22 nt, Human
uuauuacaguuucagggaagau

SEQ ID NO: 132253 - RNA, 22 nt, Human
uuuaagauauuguauuauguaa

SEQ ID NO: 132254 - RNA, 28 nt, Human
gcccuuuucagacuccugggcccuugga

SEQ ID NO: 132255 - RNA, 22 nt, Human
gccucacugcaacgccugccuc

SEQ ID NO: 132256 - RNA, 27 nt, Human
cagagcuugguuugggagguugaagug

SEQ ID NO: 132257 - RNA, 20 nt, Human
uagccuggucugugcauugu

SEQ ID NO: 132258 - RNA, 21 nt, Human
ugggacccccguggagcugac

SEQ ID NO: 132259 - RNA, 28 nt, Human
gccgccgcuccucgccuccuugcugcac

SEQ ID NO: 132260 - RNA, 22 nt, Human
aagaggaaugaacgugucugca

SEQ ID NO: 132261 - RNA, 21 nt, Human
ccuccuccagcuccugccccg

SEQ ID NO: 132262 - RNA, 27 nt, Human
ucccggauuauguggaaaacccucacu

SEQ ID NO: 132263 - RNA, 28 nt, Human
caccagugccuggccagccugcccccuu

SEQ ID NO: 132264 - RNA, 27 nt, Human
acucuucucugacguuugcuagcuuuu

SEQ ID NO: 132265 - RNA, 24 nt, Human
uugcuuuacugcaugaaugaaacu

SEQ ID NO: 132266 - RNA, 22 nt, Human
guuguaaauaaccacacugaaa

SEQ ID NO: 132267 - RNA, 23 nt, Human
uucaaagcuaaauuccacacuac

SEQ ID NO: 132268 - RNA, 21 nt, Human
uguguguguuucagcacuuug

SEQ ID NO: 132269 - RNA, 21 nt, Human
aacuucugccuucacgcugcc

SEQ ID NO: 132270 - RNA, 21 nt, Human
cuaacaccuccagguucucua

SEQ ID NO: 132271 - RNA, 22 nt, Human
uggcccaugccuguaaucccag

SEQ ID NO: 132272 - RNA, 24 nt, Human
uaggaauagagcaaauaagauaau

SEQ ID NO: 132273 - RNA, 22 nt, Human
ggccuaucuggaagccaccuca

SEQ ID NO: 132274 - RNA, 24 nt, Human
gaaucaaaggagagucccagaaaa

SEQ ID NO: 132275 - RNA, 22 nt, Human
aguugguuuucagcuggggcuu

SEQ ID NO: 132276 - RNA, 20 nt, Human
gcuccucuguggugucugcc

SEQ ID NO: 132277 - RNA, 20 nt, Human
cucuggagaggagugauauu

SEQ ID NO: 132278 - RNA, 22 nt, Human
gggcugcaggagguugcggcgg

SEQ ID NO: 132279 - RNA, 29 nt, Human
cccucucucaccucaaggcugccugcauu

SEQ ID NO: 132280 - RNA, 23 nt, Human
ccacaggaacaaugauggagauu

SEQ ID NO: 132281 - RNA, 26 nt, Human
gcugcuucuggacucaaggaggagga

SEQ ID NO: 132282 - RNA, 26 nt, Human
cccugcagucaucucagagccccuuc

SEQ ID NO: 132283 - RNA, 21 nt, Human
uucauuucuugaauuucuuau

SEQ ID NO: 132284 - RNA, 19 nt, Human
caaaccagcaacuaauaaa

SEQ ID NO: 132285 - RNA, 19 nt, Human
uauauggguugcuuuugcu

SEQ ID NO: 132286 - RNA, 20 nt, Human
ggagggagggagggagggga

SEQ ID NO: 132287 - RNA, 22 nt, Human
aggcuggagugcaguggcacua

SEQ ID NO: 132288 - RNA, 26 nt, Human
ccugcacugggcccuccggcccuccc

SEQ ID NO: 132289 - RNA, 18 nt, Human
ccgggaucccacucugau

SEQ ID NO: 132290 - RNA, 23 nt, Human
cccuccugagcugggauuacagg

SEQ ID NO: 132291 - RNA, 25 nt, Human
cguuuucccagccucagucucucuu

SEQ ID NO: 132292 - RNA, 26 nt, Human
gucaccaggauggaagggggugccuc

SEQ ID NO: 132293 - RNA, 24 nt, Human
ccugaaaacagcucccccuugcug

SEQ ID NO: 132294 - RNA, 27 nt, Human
ggacuccugcacacgcuccuuccucug

SEQ ID NO: 132295 - RNA, 22 nt, Human
gcauuacaggauccccagaaag

SEQ ID NO: 132296 - RNA, 27 nt, Human
auaucuaaaaaagaauucuuagcaaug

SEQ ID NO: 132297 - RNA, 22 nt, Human
agcagcuagaggcuccuccucu

SEQ ID NO: 132298 - RNA, 21 nt, Human
agggcccagacuuuggaauag

SEQ ID NO: 132299 - RNA, 24 nt, Human
cuaucaaucaaaauguuuguaacu

SEQ ID NO: 132300 - RNA, 27 nt, Human
cacugcaugccagaggcccauuuacuc

SEQ ID NO: 132301 - RNA, 22 nt, Human
agaccagcuuagccaacauagu

SEQ ID NO: 132302 - RNA, 22 nt, Human
uuagccauaauguaaacugccu

SEQ ID NO: 132303 - RNA, 20 nt, Human
gacuuagcuuggcauuuuag

SEQ ID NO: 132304 - RNA, 24 nt, Human
auguggcccuggcugccggcacgg

SEQ ID NO: 132305 - RNA, 22 nt, Human
agaggugaggcuuacuauucac

SEQ ID NO: 132306 - RNA, 18 nt, Human
uucuuucuccccuacucc

SEQ ID NO: 132307 - RNA, 18 nt, Human
uuguuauucagcuuuuca

SEQ ID NO: 132308 - RNA, 20 nt, Human
ucccuccagagccgggguuu

SEQ ID NO: 132309 - RNA, 27 nt, Human
auucuuucguuugacagcaguuugguu

SEQ ID NO: 132310 - RNA, 27 nt, Human
cuaccugcaaggugaaggaaggcaucc

SEQ ID NO: 132311 - RNA, 28 nt, Human
auauauauguuuaacccauuacucaaau

SEQ ID NO: 132312 - RNA, 21 nt, Human
cauagacgacuccuagaggac

SEQ ID NO: 132313 - RNA, 21 nt, Human
auggaucaaauucuaaaauaa

SEQ ID NO: 132314 - RNA, 21 nt, Human
ccucuugcauacaacugucca

SEQ ID NO: 132315 - RNA, 21 nt, Human
ugugcaugcuuuucucuugcu

SEQ ID NO: 132316 - RNA, 26 nt, Human
gcgcggagucacccagucacacuccc

SEQ ID NO: 132317 - RNA, 21 nt, Human
agaaaaggcucaacaucaacu

SEQ ID NO: 132318 - RNA, 27 nt, Human
ugauggccagauauaaccucugaggcu

SEQ ID NO: 132319 - RNA, 26 nt, Human
gcaaacugaggcagcaugcacggagg

SEQ ID NO: 132320 - RNA, 26 nt, Human
ccagaagaagaguaggugacacuaua

SEQ ID NO: 132321 - RNA, 21 nt, Human
ugcacuacuacacuccagccu

SEQ ID NO: 132322 - RNA, 27 nt, Human
auacauacaguaggugaauuuucagga

SEQ ID NO: 132323 - RNA, 21 nt, Human
ucucuuucuuguccucccagc

SEQ ID NO: 132324 - RNA, 26 nt, Human
gcccuccuccccuccuugcaccggcc

SEQ ID NO: 132325 - RNA, 29 nt, Human
gcuauauuuugugagugcaagcuggcuug

SEQ ID NO: 132326 - RNA, 22 nt, Human
ugucgcucagccuggagugcag

SEQ ID NO: 132327 - RNA, 24 nt, Human
cccagcacagcuugaccugaggcu

SEQ ID NO: 132328 - RNA, 22 nt, Human
aacguggccuauagcuucccuu

SEQ ID NO: 132329 - RNA, 20 nt, Human
uggacugugcuggugcauca

SEQ ID NO: 132330 - RNA, 22 nt, Human
gcuggucucuaacuccugggcu

SEQ ID NO: 132331 - RNA, 21 nt, Human
gccgacuuccccuccucuucc

SEQ ID NO: 132332 - RNA, 25 nt, Human
ggccugcagaagucccaggcgaccc

SEQ ID NO: 132333 - RNA, 25 nt, Human
ccucuuccuccuccugugggacugc

SEQ ID NO: 132334 - RNA, 25 nt, Human
ggucaaggcaacaucuccacacaga

SEQ ID NO: 132335 - RNA, 24 nt, Human
cgauaugacuuccuuuuguaaugc

SEQ ID NO: 132336 - RNA, 22 nt, Human
ugaaaccagaagaagugugaga

SEQ ID NO: 132337 - RNA, 19 nt, Human
gacucucccacaugcucug

SEQ ID NO: 132338 - RNA, 23 nt, Human
uccaggagguugaggcugcagug

SEQ ID NO: 132339 - RNA, 21 nt, Human
ccugaaaucuuagcacuucgg

SEQ ID NO: 132340 - RNA, 22 nt, Human
ggaaaugcugaugacuucuuua

SEQ ID NO: 132341 - RNA, 20 nt, Human
gcggaaggcguggcagggag

SEQ ID NO: 132342 - RNA, 23 nt, Human
acccccacucucugcgacggccc

SEQ ID NO: 132343 - RNA, 27 nt, Human
ggggaaagaaaacucacgaagcagagg

SEQ ID NO: 132344 - RNA, 21 nt, Human
gggccugggaagaauauuaaa

SEQ ID NO: 132345 - RNA, 20 nt, Human
ggacuucucuuuagucaggg

SEQ ID NO: 132346 - RNA, 22 nt, Human
gcauacguacauuccuggacac

SEQ ID NO: 132347 - RNA, 20 nt, Human
uaacccaccaaccugccugu

SEQ ID NO: 132348 - RNA, 21 nt, Human
ugcugcuggaugaugagggag

SEQ ID NO: 132349 - RNA, 23 nt, Human
uacauggcaucugccacagcaga

SEQ ID NO: 132350 - RNA, 22 nt, Human
cccaaagugcuaggauuacagg

SEQ ID NO: 132351 - RNA, 22 nt, Human
cccaaagugcugggauuacggg

SEQ ID NO: 132352 - RNA, 27 nt, Human
cucauuucuuaugaaucuuuccaggga

SEQ ID NO: 132353 - RNA, 21 nt, Human
agggagggagggaaagcuucc

SEQ ID NO: 132354 - RNA, 26 nt, Human
ucaaaucccaaaccauuacugagggg

SEQ ID NO: 132355 - RNA, 22 nt, Human
ggaagcaguuccagggagaguc

SEQ ID NO: 132356 - RNA, 22 nt, Human
cugaguagcugggauuucaggc

SEQ ID NO: 132357 - RNA, 24 nt, Human
ugcucuauggcccuuccucaucag

SEQ ID NO: 132358 - RNA, 32 nt, Human
agauaaauguguaaugaacaaagauauguugu

SEQ ID NO: 132359 - RNA, 26 nt, Human
gggcuuggaaggaaaacaccuuucca

SEQ ID NO: 132360 - RNA, 24 nt, Human
acaguggcauaaucacagcucacu

SEQ ID NO: 132361 - RNA, 25 nt, Human
ccucucugcugaggcagcugccucc

SEQ ID NO: 132362 - RNA, 23 nt, Human
ugagaagccauggaagguugugg

SEQ ID NO: 132363 - RNA, 27 nt, Human
uugagacagagucucacucuguguccc

SEQ ID NO: 132364 - RNA, 22 nt, Human
ccuauuccuuguucccuggugg

SEQ ID NO: 132365 - RNA, 25 nt, Human
uacuuuuaagauuguggagucugag

SEQ ID NO: 132366 - RNA, 18 nt, Human
uucaucuaaaaauguuag

SEQ ID NO: 132367 - RNA, 26 nt, Human
ugggacccuaccccuuccaaccuucc

SEQ ID NO: 132368 - RNA, 26 nt, Human
cacuuccugggaggucagagacaaac

SEQ ID NO: 132369 - RNA, 24 nt, Human
aaaucaggacuaaguccucugcuu

SEQ ID NO: 132370 - RNA, 27 nt, Human
gcugcaacccagcugcuggacugaucu

SEQ ID NO: 132371 - RNA, 24 nt, Human
cacaugccuaugauccagcuuugg

SEQ ID NO: 132372 - RNA, 23 nt, Human
cacucacggauaagacaccaaga

SEQ ID NO: 132373 - RNA, 21 nt, Human
agaguaaauaucuacucacuc

SEQ ID NO: 132374 - RNA, 16 nt, Human
aucuccuugugcucag

SEQ ID NO: 132375 - RNA, 23 nt, Human
uaacauccuuguuuuagaauucu

SEQ ID NO: 132376 - RNA, 26 nt, Human
uguuaugugcauuucuagaaauacau

SEQ ID NO: 132377 - RNA, 25 nt, Human
ucauuccccucuuuugucuuccuca

SEQ ID NO: 132378 - RNA, 22 nt, Human
cuacuucugggaaaaacaacau

SEQ ID NO: 132379 - RNA, 20 nt, Human
ggccuacaacgaggggccuu

SEQ ID NO: 132380 - RNA, 25 nt, Human
ccauagcaaagaugcuucaguccag

SEQ ID NO: 132381 - RNA, 24 nt, Human
cacggcgaaggucugcagcuucac

SEQ ID NO: 132382 - RNA, 28 nt, Human
caugaccuuucgugauuauccgcaaaug

SEQ ID NO: 132383 - RNA, 22 nt, Human
ugcaaccucugucucccggguu

SEQ ID NO: 132384 - RNA, 22 nt, Human
agaccagccugggcaauauagc

SEQ ID NO: 132385 - RNA, 24 nt, Human
ucgcgcagcccgggagaagggagc

SEQ ID NO: 132386 - RNA, 22 nt, Human
ggccggcacccgggagaaggag

SEQ ID NO: 132387 - RNA, 23 nt, Human
cuuccuaugugucuuuugaaucu

SEQ ID NO: 132388 - RNA, 24 nt, Human
uacgagcaccuccagccugaacag

SEQ ID NO: 132389 - RNA, 21 nt, Human
uuuccucccuucaccuuccca

SEQ ID NO: 132390 - RNA, 21 nt, Human
ucccaccucagccuccuagca

SEQ ID NO: 132391 - RNA, 17 nt, Human
agcagccacacuuccuu

SEQ ID NO: 132392 - RNA, 26 nt, Human
cccagccaucggggaagggucagggc

SEQ ID NO: 132393 - RNA, 27 nt, Human
ugaggugggagccugggaggucaaggc

SEQ ID NO: 132394 - RNA, 18 nt, Human
acagaaguuccaacuauu

SEQ ID NO: 132395 - RNA, 26 nt, Human
aaagggagacccuuuugggggaugag

SEQ ID NO: 132396 - RNA, 19 nt, Human
ucacagaaaacauugacug

SEQ ID NO: 132397 - RNA, 25 nt, Human
gggggagaagagguuaguggaucgg

SEQ ID NO: 132398 - RNA, 22 nt, Human
acccauggcaggcagugaaaag

SEQ ID NO: 132399 - RNA, 23 nt, Human
ucuuugguauugugccucugcuc

SEQ ID NO: 132400 - RNA, 25 nt, Human
gaguucugcuuacuucaguccugcu

SEQ ID NO: 132401 - RNA, 22 nt, Human
gaucccagcagugauguugguu

SEQ ID NO: 132402 - RNA, 21 nt, Human
guguuuuggcaccugccugua

SEQ ID NO: 132403 - RNA, 22 nt, Human
uucuacuuugcuuuucucucca

SEQ ID NO: 132404 - RNA, 24 nt, Human
ugucauucuuaucuccagccuggg

SEQ ID NO: 132405 - RNA, 22 nt, Human
gccuggaggugugugggccagg

SEQ ID NO: 132406 - RNA, 22 nt, Human
cccaccccguucggccccgccc

SEQ ID NO: 132407 - RNA, 21 nt, Human
agcucccaaguagcugggauu

SEQ ID NO: 132408 - RNA, 24 nt, Human
gcgccaucuuggcucacugcaacc

SEQ ID NO: 132409 - RNA, 22 nt, Human
cgaacuccugaccucaagcgau

SEQ ID NO: 132410 - RNA, 23 nt, Human
caaguagcuggaauuacaggcac

SEQ ID NO: 132411 - RNA, 22 nt, Human
ugcauugucucuugacaucaga

SEQ ID NO: 132412 - RNA, 21 nt, Human
uuaugcaccaccucccuucag

SEQ ID NO: 132413 - RNA, 18 nt, Human
cccugcagggccuuucua

SEQ ID NO: 132414 - RNA, 25 nt, Human
uucuccucccuuuuacuuugccggu

SEQ ID NO: 132415 - RNA, 21 nt, Human
acuaaaauaacaauguuucag

SEQ ID NO: 132416 - RNA, 25 nt, Human
ccucacucguuauucuccaucuguu

SEQ ID NO: 132417 - RNA, 27 nt, Human
ccagcacucugccuucuguauccacca

SEQ ID NO: 132418 - RNA, 22 nt, Human
cuccuccuggauucaagcaauu

SEQ ID NO: 132419 - RNA, 22 nt, Human
cgccuccuguguucaagcgauu

SEQ ID NO: 132420 - RNA, 26 nt, Human
uucuugagggccuccccaccgcagca

SEQ ID NO: 132421 - RNA, 24 nt, Human
ccagccccucacaccaccgccagg

SEQ ID NO: 132422 - RNA, 27 nt, Human
ccucacccucccauguagcugggauua

SEQ ID NO: 132423 - RNA, 22 nt, Human
caaaggaauguccauuugcuga

SEQ ID NO: 132424 - RNA, 21 nt, Human
gccagccaauucaucaacauu

SEQ ID NO: 132425 - RNA, 19 nt, Human
uugacuugccacugccaua

SEQ ID NO: 132426 - RNA, 22 nt, Human
gggaggcacauccaggcuuggg

SEQ ID NO: 132427 - RNA, 27 nt, Human
agaggcaccaguccagcaaauaaagca

SEQ ID NO: 132428 - RNA, 21 nt, Human
cugggcuggaggcagggagac

SEQ ID NO: 132429 - RNA, 21 nt, Human
ccucuagcuuuucuauuuuug

SEQ ID NO: 132430 - RNA, 21 nt, Human
guccucgagggucauggcuug

SEQ ID NO: 132431 - RNA, 22 nt, Human
cuacaugaucuagagccaguua

SEQ ID NO: 132432 - RNA, 22 nt, Human
auaauacuuccaaauuuuauga

SEQ ID NO: 132433 - RNA, 25 nt, Human
ggacccgcuacugccugcccccaac

SEQ ID NO: 132434 - RNA, 26 nt, Human
auuucccguccaaugccugcaugcug

SEQ ID NO: 132435 - RNA, 25 nt, Human
gcccaggcuggagugcaguggcggg

SEQ ID NO: 132436 - RNA, 19 nt, Human
ccuccagggcccuguuugg

SEQ ID NO: 132437 - RNA, 21 nt, Human
gcccaaccucagcaaccugua

SEQ ID NO: 132438 - RNA, 16 nt, Human
acugcuuccauggccc

SEQ ID NO: 132439 - RNA, 22 nt, Human
gccuguaaucccagugacuugg

SEQ ID NO: 132440 - RNA, 23 nt, Human
aaaaauuuaguggauuuugaaaa

SEQ ID NO: 132441 - RNA, 29 nt, Human
ucaggaguauaucauuugcagugcuugua

SEQ ID NO: 132442 - RNA, 20 nt, Human
uaccauucuauucuccagac

SEQ ID NO: 132443 - RNA, 26 nt, Human
cacccaggccagggguccagagcuaa

SEQ ID NO: 132444 - RNA, 20 nt, Human
cuccccucagccuuguggcc

SEQ ID NO: 132445 - RNA, 22 nt, Human
cagccagcauccuuaucugcca

SEQ ID NO: 132446 - RNA, 20 nt, Human
ggaggaggagggaggccagg

SEQ ID NO: 132447 - RNA, 20 nt, Human
aucaaauuggccacuuaaga

SEQ ID NO: 132448 - RNA, 26 nt, Human
aacacucccucuucccagauucucug

SEQ ID NO: 132449 - RNA, 27 nt, Human
ggcagugagacugaggaugaggacagc

SEQ ID NO: 132450 - RNA, 20 nt, Human
ggaggcggagguuguaguga

SEQ ID NO: 132451 - RNA, 23 nt, Human
cagugacccaggagucugggcca

SEQ ID NO: 132452 - RNA, 20 nt, Human
acagacuaugcuccaggaag

SEQ ID NO: 132453 - RNA, 25 nt, Human
uuucuuuucuauuccaucaucugcc

SEQ ID NO: 132454 - RNA, 25 nt, Human
cagcccaggagggcgggugguuugu

SEQ ID NO: 132455 - RNA, 22 nt, Human
uggugggcacccguaaucccag

SEQ ID NO: 132456 - RNA, 22 nt, Human
aacucccacaagcucugccuuc

SEQ ID NO: 132457 - RNA, 27 nt, Human
ggguccccagcccaggagguggcugga

SEQ ID NO: 132458 - RNA, 23 nt, Human
uacacaucaaaaucauaauaaua

SEQ ID NO: 132459 - RNA, 25 nt, Human
ccucauugcgccucagucuuuaagg

SEQ ID NO: 132460 - RNA, 24 nt, Human
cuuuaguaucgucaauggugccac

SEQ ID NO: 132461 - RNA, 24 nt, Human
ggagguugagaggaggacuugguu

SEQ ID NO: 132462 - RNA, 23 nt, Human
ccaagaaaugugcagucuguaaa

SEQ ID NO: 132463 - RNA, 22 nt, Human
gcugcuucuuucuuuaaaacaa

SEQ ID NO: 132464 - RNA, 21 nt, Human
ucguggcgcauggcuugggga

SEQ ID NO: 132465 - RNA, 22 nt, Human
gauaggauuuggggcagaggga

SEQ ID NO: 132466 - RNA, 21 nt, Human
aaagcugacaguuucuuuacu

SEQ ID NO: 132467 - RNA, 19 nt, Human
ugcucuacucgcugccauu

SEQ ID NO: 132468 - RNA, 25 nt, Human
uaacaccuguugcauuuauauucuu

SEQ ID NO: 132469 - RNA, 22 nt, Human
agcacuucugaaaacagcacuu

SEQ ID NO: 132470 - RNA, 27 nt, Human
gcuguuucucugacuccuuguggcauc

SEQ ID NO: 132471 - RNA, 23 nt, Human
gggcuggaagccacggguacggu

SEQ ID NO: 132472 - RNA, 13 nt, Human
uagaaaaaugcac

SEQ ID NO: 132473 - RNA, 22 nt, Human
uuucaugugccugaaggcuauc

SEQ ID NO: 132474 - RNA, 22 nt, Human
ggccugagccuucagcccacgg

SEQ ID NO: 132475 - RNA, 19 nt, Human
cugggacaaagauggggaa

SEQ ID NO: 132476 - RNA, 25 nt, Human
ccaguuccauuucucucauucacaa

SEQ ID NO: 132477 - RNA, 23 nt, Human
cacacagucuguauuacuucagg

SEQ ID NO: 132478 - RNA, 25 nt, Human
acucguguauuaagucauucacuuu

SEQ ID NO: 132479 - RNA, 26 nt, Human
ucagcacuuuaaagaggcuguguggc

SEQ ID NO: 132480 - RNA, 22 nt, Human
cacacaacagguuucuacucuc

SEQ ID NO: 132481 - RNA, 24 nt, Human
cauuuucauagugucaagaaggaa

SEQ ID NO: 132482 - RNA, 26 nt, Human
aggaagagauuuaagcaugcuugcuu

SEQ ID NO: 132483 - RNA, 23 nt, Human
aucuccugcugccuucagcugcc

SEQ ID NO: 132484 - RNA, 18 nt, Human
accaucaucacaguguuu

SEQ ID NO: 132485 - RNA, 28 nt, Human
gagagcugugcuccaggccagggguuac

SEQ ID NO: 132486 - RNA, 27 nt, Human
ccauguuccguuugaucuuggcaauuu

SEQ ID NO: 132487 - RNA, 23 nt, Human
uuucuuuucuuugcccuccugau

SEQ ID NO: 132488 - RNA, 20 nt, Human
agucauccuggagcacagcu

SEQ ID NO: 132489 - RNA, 24 nt, Human
cuauacagcugaagaacaucucga

SEQ ID NO: 132490 - RNA, 21 nt, Human
gugugaaauauaagcuuuuua

SEQ ID NO: 132491 - RNA, 26 nt, Human
uaguaaacugugcuuucuauuaucua

SEQ ID NO: 132492 - RNA, 27 nt, Human
gucgcccaggcuggagugcagcagcac

SEQ ID NO: 132493 - RNA, 21 nt, Human
aaaaggagacagaagauugaa

SEQ ID NO: 132494 - RNA, 22 nt, Human
gcaggcagaucaccugaaguca

SEQ ID NO: 132495 - RNA, 21 nt, Human
cuccacccuccccaccuggcu

SEQ ID NO: 132496 - RNA, 23 nt, Human
gaggacaugggguucauuguaca

SEQ ID NO: 132497 - RNA, 21 nt, Human
uuuacuuccuugcacugucuu

SEQ ID NO: 132498 - RNA, 27 nt, Human
caguagcugcaucuccagguuuugagu

SEQ ID NO: 132499 - RNA, 22 nt, Human
caccuauaaucccagcacuuug

SEQ ID NO: 132500 - RNA, 22 nt, Human
caccuguaaucccagcacuuua

SEQ ID NO: 132501 - RNA, 22 nt, Human
ggcgcuaggcccgggaggagag

SEQ ID NO: 132502 - RNA, 23 nt, Human
gccugagcucccugucucuccuc

SEQ ID NO: 132503 - RNA, 22 nt, Human
caaaacaaaccaugauggagug

SEQ ID NO: 132504 - RNA, 19 nt, Human
aacaaauucugauacaggc

SEQ ID NO: 132505 - RNA, 26 nt, Human
ggagagaagugagaauaggcagcccc

SEQ ID NO: 132506 - RNA, 28 nt, Human
ucucggagagcugacaccaaguccuccc

SEQ ID NO: 132507 - RNA, 23 nt, Human
gcauuuauaauaauuauauguga

SEQ ID NO: 132508 - RNA, 26 nt, Human
gugaaaaacaacaaauucaguucuga

SEQ ID NO: 132509 - RNA, 22 nt, Human
cagcacuuggagaggcugaggu

SEQ ID NO: 132510 - RNA, 21 nt, Human
ucccuguaacugagauuucua

SEQ ID NO: 132511 - RNA, 21 nt, Human
cagagcuggagugcagcggca

SEQ ID NO: 132512 - RNA, 22 nt, Human
uguuguggguuggagaaaagug

SEQ ID NO: 132513 - RNA, 18 nt, Human
acagaagaaaagcaugca

SEQ ID NO: 132514 - RNA, 25 nt, Human
uuguccacuucucagcgaggauggc

SEQ ID NO: 132515 - RNA, 22 nt, Human
cugcaaccucugccacccgggu

SEQ ID NO: 132516 - RNA, 24 nt, Human
caggaagguaggagaaggcaucug

SEQ ID NO: 132517 - RNA, 23 nt, Human
gugagugccugcaggagagacac

SEQ ID NO: 132518 - RNA, 24 nt, Human
agagcagacagaagcaggguggug

SEQ ID NO: 132519 - RNA, 24 nt, Human
acucucuucuccucccuagugcga

SEQ ID NO: 132520 - RNA, 23 nt, Human
cagggagggggcgcgggagccgc

SEQ ID NO: 132521 - RNA, 20 nt, Human
ccucucuccaccugccucug

SEQ ID NO: 132522 - RNA, 22 nt, Human
cucaaguaauccuccugccuca

SEQ ID NO: 132523 - RNA, 23 nt, Human
cacuccuguaaucccagcuacuu

SEQ ID NO: 132524 - RNA, 23 nt, Human
gcccuggcugugaaaagaaucuc

SEQ ID NO: 132525 - RNA, 22 nt, Human
ucauucaaaacaaccauccugc

SEQ ID NO: 132526 - RNA, 26 nt, Human
gaguuggucuggaggaggaggaggac

SEQ ID NO: 132527 - RNA, 23 nt, Human
ugcaaagcaaaacagacuguguu

SEQ ID NO: 132528 - RNA, 20 nt, Human
uccuguugccaucagugccc

SEQ ID NO: 132529 - RNA, 20 nt, Human
auagaagagaaaaaagagca

SEQ ID NO: 132530 - RNA, 22 nt, Human
uugccuguaaucccagcacuuu

SEQ ID NO: 132531 - RNA, 23 nt, Human
gccccuugcuucucaacuaaaga

SEQ ID NO: 132532 - RNA, 27 nt, Human
cucagcagggcagcucagccgacagcc

SEQ ID NO: 132533 - RNA, 22 nt, Human
uugcccaggcuugagugcaaug

SEQ ID NO: 132534 - RNA, 25 nt, Human
agagcuuugcuuauauuuuguucuu

SEQ ID NO: 132535 - RNA, 22 nt, Human
cuuccaguguggcaucucagca

SEQ ID NO: 132536 - RNA, 26 nt, Human
gucuugaacuccuggccugaagcaau

SEQ ID NO: 132537 - RNA, 22 nt, Human
ccaggaggcggagguugcagug

SEQ ID NO: 132538 - RNA, 22 nt, Human
ucaggagguggagguugcagug

SEQ ID NO: 132539 - RNA, 22 nt, Human
agucacccaugcaccuggucau

SEQ ID NO: 132540 - RNA, 24 nt, Human
ccuucuauacccacccagaaugag

SEQ ID NO: 132541 - RNA, 18 nt, Human
ccugccgccuccucucag

SEQ ID NO: 132542 - RNA, 20 nt, Human
ugucaauaaagcaaaguacu

SEQ ID NO: 132543 - RNA, 27 nt, Human
acuuaggacugcgggguuuagguuaga

SEQ ID NO: 132544 - RNA, 24 nt, Human
aguuugcccccggaggaggcaggg

SEQ ID NO: 132545 - RNA, 24 nt, Human
agcuggguuuauucaaagugggcg

SEQ ID NO: 132546 - RNA, 18 nt, Human
aggaaggaaagaugugaa

SEQ ID NO: 132547 - RNA, 21 nt, Human
guuguuguuuuucuggaaacu

SEQ ID NO: 132548 - RNA, 27 nt, Human
ggccccacccucaccacccaggaaagg

SEQ ID NO: 132549 - RNA, 23 nt, Human
agagaggaaaagaugagauccac

SEQ ID NO: 132550 - RNA, 20 nt, Human
gcugcuugaagguuugucca

SEQ ID NO: 132551 - RNA, 20 nt, Human
uucaguuauuaaaugauaga

SEQ ID NO: 132552 - RNA, 17 nt, Human
ucugccugccggccugg

SEQ ID NO: 132553 - RNA, 26 nt, Human
ccccugccaugcucucacccugcaua

SEQ ID NO: 132554 - RNA, 20 nt, Human
agcagagcaggcaggcagag

SEQ ID NO: 132555 - RNA, 28 nt, Human
agagcugcaaacacagagcccaccacaa

SEQ ID NO: 132556 - RNA, 20 nt, Human
cuaaagcagagucuagguuu

SEQ ID NO: 132557 - RNA, 21 nt, Human
agauggcgccaucacacucca

SEQ ID NO: 132558 - RNA, 22 nt, Human
ccugugcugcugcaccaaccuc

SEQ ID NO: 132559 - RNA, 21 nt, Human
gaggcucaagccagaaauuca

SEQ ID NO: 132560 - RNA, 22 nt, Human
aaacuccugggcucaagcaaug

SEQ ID NO: 132561 - RNA, 22 nt, Human
gcuguguuuugagcagcaggua

SEQ ID NO: 132562 - RNA, 21 nt, Human
auuucgaacuccugaccucag

SEQ ID NO: 132563 - RNA, 21 nt, Human
cuugccucuuuuaccugcugc

SEQ ID NO: 132564 - RNA, 28 nt, Human
cugcggaaccuccaccccuccagugggu

SEQ ID NO: 132565 - RNA, 28 nt, Human
accagaaccuagccuccugcagaccucc

SEQ ID NO: 132566 - RNA, 22 nt, Human
agaggugggcaggguggauggc

SEQ ID NO: 132567 - RNA, 21 nt, Human
cacugcacagaccuuagggaa

SEQ ID NO: 132568 - RNA, 27 nt, Human
uguccuuuugugaaaucaguaucagaa

SEQ ID NO: 132569 - RNA, 21 nt, Human
ucagcucccuuauacccccau

SEQ ID NO: 132570 - RNA, 22 nt, Human
guggaauccaacuuuucccgug

SEQ ID NO: 132571 - RNA, 27 nt, Human
gcccagccucuguggcccugugaccug

SEQ ID NO: 132572 - RNA, 25 nt, Human
gggcuagcaucccugaggagccagg

SEQ ID NO: 132573 - RNA, 21 nt, Human
ucauaggcaaaucaguuaccu

SEQ ID NO: 132574 - RNA, 22 nt, Human
cagugcuguugguggcagugac

SEQ ID NO: 132575 - RNA, 23 nt, Human
agugagguggaaggauguuugcu

SEQ ID NO: 132576 - RNA, 21 nt, Human
uugaaugucuuucacuccuuu

SEQ ID NO: 132577 - RNA, 26 nt, Human
gucaauguuaaauuucuugcaugcca

SEQ ID NO: 132578 - RNA, 24 nt, Human
cccaacugcaccagcacugccucc

SEQ ID NO: 132579 - RNA, 22 nt, Human
acugacccagcccgggaggcag

SEQ ID NO: 132580 - RNA, 23 nt, Human
ucauuucagccucuggauggcug

SEQ ID NO: 132581 - RNA, 19 nt, Human
gaccuccacccacugugga

SEQ ID NO: 132582 - RNA, 24 nt, Human
aagguaaugaagcaacuauuucua

SEQ ID NO: 132583 - RNA, 20 nt, Human
augucugccacaaaagauag

SEQ ID NO: 132584 - RNA, 21 nt, Human
ugguggcaccaggauggaagg

SEQ ID NO: 132585 - RNA, 21 nt, Human
agccaacaucgugaaacccca

SEQ ID NO: 132586 - RNA, 17 nt, Human
aauaccuuaauucucua

SEQ ID NO: 132587 - RNA, 21 nt, Human
auucauaucauuuggccgagu

SEQ ID NO: 132588 - RNA, 21 nt, Human
cacaucaguggcaugcuucau

SEQ ID NO: 132589 - RNA, 25 nt, Human
aggcaacgggcggcagguugcagug

SEQ ID NO: 132590 - RNA, 26 nt, Human
cagcacaccaacauggcauauguaua

SEQ ID NO: 132591 - RNA, 23 nt, Human
uuuugagauuaagaaugccagga

SEQ ID NO: 132592 - RNA, 20 nt, Human
gcugauuuuccugaaacacu

SEQ ID NO: 132593 - RNA, 22 nt, Human
cucagcuucccaaguagcugag

SEQ ID NO: 132594 - RNA, 25 nt, Human
gcuccucugauggcugacaucaguc

SEQ ID NO: 132595 - RNA, 23 nt, Human
gccaagguggaggcugagguggc

SEQ ID NO: 132596 - RNA, 24 nt, Human
auuuucugucacagacacucaggg

SEQ ID NO: 132597 - RNA, 20 nt, Human
ugugcucacuaccuggguga

SEQ ID NO: 132598 - RNA, 22 nt, Human
uucccuuuccuuucuccagucc

SEQ ID NO: 132599 - RNA, 20 nt, Human
gaaguagugugaguguuaga

SEQ ID NO: 132600 - RNA, 24 nt, Human
aguggucuuacuggcagguguugg

SEQ ID NO: 132601 - RNA, 23 nt, Human
ggggugaggcugaaacagugacc

SEQ ID NO: 132602 - RNA, 27 nt, Human
aaagugcugggauuacagacacgagcc

SEQ ID NO: 132603 - RNA, 26 nt, Human
uggcugugaggaaacagccacauguu

SEQ ID NO: 132604 - RNA, 23 nt, Human
uccuaggacugggccuucuucca

SEQ ID NO: 132605 - RNA, 21 nt, Human
gugaacuugggccacugugaa

SEQ ID NO: 132606 - RNA, 29 nt, Human
uugcccaguaguuggaaagugaacucgac

SEQ ID NO: 132607 - RNA, 20 nt, Human
gguggcagcugugggaggag

SEQ ID NO: 132608 - RNA, 25 nt, Human
ggcagaaccuagucuuguuguucau

SEQ ID NO: 132609 - RNA, 23 nt, Human
ccaggagcccuucaaggucucca

SEQ ID NO: 132610 - RNA, 26 nt, Human
ucaugggggcucuuucgcugcagccu

SEQ ID NO: 132611 - RNA, 27 nt, Human
agucaagcuucagaauauuuccaucac

SEQ ID NO: 132612 - RNA, 23 nt, Human
ucugaacucuucuugauuuuaau

SEQ ID NO: 132613 - RNA, 23 nt, Human
cugcccuuauuuuaaaagccagu

SEQ ID NO: 132614 - RNA, 27 nt, Human
ggggcaggggagucagcagaggccucg

SEQ ID NO: 132615 - RNA, 19 nt, Human
aggggcuucagcccgggag

SEQ ID NO: 132616 - RNA, 20 nt, Human
uagggguucagaaauggugc

SEQ ID NO: 132617 - RNA, 25 nt, Human
auugcauucagccuaguuccugguu

SEQ ID NO: 132618 - RNA, 25 nt, Human
cccagcacuccucugggcugcucuc

SEQ ID NO: 132619 - RNA, 27 nt, Human
ggagagggagcuuggagaacucacugu

SEQ ID NO: 132620 - RNA, 21 nt, Human
ucauaacucuguaucugagca

SEQ ID NO: 132621 - RNA, 22 nt, Human
ccucugcaaagugcccucuugg

SEQ ID NO: 132622 - RNA, 23 nt, Human
cccaugaggacccucaggcccgg

SEQ ID NO: 132623 - RNA, 26 nt, Human
aacuuugccagcuuuuccucccuugg

SEQ ID NO: 132624 - RNA, 22 nt, Human
cagaaguucaaggcugcaauga

SEQ ID NO: 132625 - RNA, 22 nt, Human
uuaucgaguaccuacucuguca

SEQ ID NO: 132626 - RNA, 22 nt, Human
uuccccugcucaccacugaggc

SEQ ID NO: 132627 - RNA, 22 nt, Human
agaggcuggagugggggugugu

SEQ ID NO: 132628 - RNA, 24 nt, Human
ggcaacuuagagguggggagcaga

SEQ ID NO: 132629 - RNA, 25 nt, Human
cgcuuggaaaucucccuuucugcuu

SEQ ID NO: 132630 - RNA, 22 nt, Human
ggaaaggccuguggggagccac

SEQ ID NO: 132631 - RNA, 23 nt, Human
gagucucggcugacauaauccuc

SEQ ID NO: 132632 - RNA, 24 nt, Human
aagcaagccuagccuuccagggag

SEQ ID NO: 132633 - RNA, 21 nt, Human
cugccccggcgcggggccacu

SEQ ID NO: 132634 - RNA, 27 nt, Human
uaugcagaaauagacaaaaaguauauu

SEQ ID NO: 132635 - RNA, 27 nt, Human
acgugggagagcuccgcggggagcagc

SEQ ID NO: 132636 - RNA, 19 nt, Human
uguacuggggagucacgga

SEQ ID NO: 132637 - RNA, 29 nt, Human
uggguggaggggcagggaggcaaaaugag

SEQ ID NO: 132638 - RNA, 21 nt, Human
ugucuauggugagaacacagg

SEQ ID NO: 132639 - RNA, 26 nt, Human
ggcuuaccugaccucuugcugucucu

SEQ ID NO: 132640 - RNA, 22 nt, Human
aaggcgcccucgcacucagcuu

SEQ ID NO: 132641 - RNA, 24 nt, Human
gucuucaucucccugccauccccc

SEQ ID NO: 132642 - RNA, 22 nt, Human
ucuuccgcccaggcugcagugc

SEQ ID NO: 132643 - RNA, 19 nt, Human
agcgcggagcgcugagcca

SEQ ID NO: 132644 - RNA, 25 nt, Human
gggagcauucaccugcccugucucc

SEQ ID NO: 132645 - RNA, 22 nt, Human
aggcuggagugcaaugcacgau

SEQ ID NO: 132646 - RNA, 19 nt, Human
ggcucacugccuccugccc

SEQ ID NO: 132647 - RNA, 24 nt, Human
agcuuuauuuguuaauaguuccug

SEQ ID NO: 132648 - RNA, 27 nt, Human
uccauuguaaauuugaaacaaagaccg

SEQ ID NO: 132649 - RNA, 27 nt, Human
ccagaagccagaggauggacuaagugg

SEQ ID NO: 132650 - RNA, 26 nt, Human
gccagccacagaccccugggagcuuc

SEQ ID NO: 132651 - RNA, 24 nt, Human
gaugccagcuguacugaguucuca

SEQ ID NO: 132652 - RNA, 21 nt, Human
acaguauuuaaauauugcaaa

SEQ ID NO: 132653 - RNA, 21 nt, Human
ucacgaguaagauuaagagca

SEQ ID NO: 132654 - RNA, 22 nt, Human
cccugcaccucccaccaagggg

SEQ ID NO: 132655 - RNA, 22 nt, Human
cgggaagcagagguugcaguga

SEQ ID NO: 132656 - RNA, 23 nt, Human
gagcagcauuauccccaaagaua

SEQ ID NO: 132657 - RNA, 23 nt, Human
aacucugcccuucucccauccaa

SEQ ID NO: 132658 - RNA, 23 nt, Human
ccugggucuuauucuguccuucu

SEQ ID NO: 132659 - RNA, 22 nt, Human
caucuccuaggcucaagccauu

SEQ ID NO: 132660 - RNA, 22 nt, Human
guuuugguuuuguuuucuguuu

SEQ ID NO: 132661 - RNA, 28 nt, Human
uuucugugggaaauaaaauaacuaauuu

SEQ ID NO: 132662 - RNA, 22 nt, Human
aaugucaugcaccgcugcagcc

SEQ ID NO: 132663 - RNA, 27 nt, Human
aggguucugcccccagauuucgggaga

SEQ ID NO: 132664 - RNA, 23 nt, Human
ugcacacaagagaaaucaacuuc

SEQ ID NO: 132665 - RNA, 21 nt, Human
gaggccagacugggcuguagu

SEQ ID NO: 132666 - RNA, 27 nt, Human
cuaagugcauuuucaucacagaaaaga

SEQ ID NO: 132667 - RNA, 22 nt, Human
cuccaucucagccauuggggca

SEQ ID NO: 132668 - RNA, 20 nt, Human
uugcauauucacaugaucau

SEQ ID NO: 132669 - RNA, 20 nt, Human
cugcugggggcaacuggcca

SEQ ID NO: 132670 - RNA, 22 nt, Human
ccgaggugggaggauugcuuga

SEQ ID NO: 132671 - RNA, 19 nt, Human
caaaaacaccaccaaucac

SEQ ID NO: 132672 - RNA, 24 nt, Human
cccaguguacuuagaaaggaucuc

SEQ ID NO: 132673 - RNA, 21 nt, Human
gcuuccucuuccgggcagaaa

SEQ ID NO: 132674 - RNA, 26 nt, Human
agcucacuguaggcuagccucugcuu

SEQ ID NO: 132675 - RNA, 20 nt, Human
ucuguuuucucuugccaaag

SEQ ID NO: 132676 - RNA, 23 nt, Human
ugcuucccaguccugccugaaca

SEQ ID NO: 132677 - RNA, 22 nt, Human
guuggagaagagguaagcgguu

SEQ ID NO: 132678 - RNA, 23 nt, Human
ugcagggacaguugggugugaga

SEQ ID NO: 132679 - RNA, 23 nt, Human
ugggguggaagggugauggggag

SEQ ID NO: 132680 - RNA, 22 nt, Human
aguucacaccugcagauucuag

SEQ ID NO: 132681 - RNA, 21 nt, Human
uccucuauuuugaauuuuuug

SEQ ID NO: 132682 - RNA, 22 nt, Human
caccuguaaucccaacauuuug

SEQ ID NO: 132683 - RNA, 23 nt, Human
ugcuagggugggaagcuggugag

SEQ ID NO: 132684 - RNA, 18 nt, Human
caggcagcuaugcaguug

SEQ ID NO: 132685 - RNA, 32 nt, Human
cccuccccucuuccauaaaggcugcaggagac

SEQ ID NO: 132686 - RNA, 24 nt, Human
cucuugcguguccaaaaguagccc

SEQ ID NO: 132687 - RNA, 22 nt, Human
agucaagucuaccugccuugcc

SEQ ID NO: 132688 - RNA, 23 nt, Human
gguucugcaaugacugcagggcu

SEQ ID NO: 132689 - RNA, 25 nt, Human
ccagagaccucacguguggagccag

SEQ ID NO: 132690 - RNA, 28 nt, Human
cgagccccgucucccagggaguccgggg

SEQ ID NO: 132691 - RNA, 20 nt, Human
ucuggaggaggaggaaaaag

SEQ ID NO: 132692 - RNA, 22 nt, Human
agcacaaagacacagacuuggg

SEQ ID NO: 132693 - RNA, 21 nt, Human
ucuauuucucaaccuuaggca

SEQ ID NO: 132694 - RNA, 23 nt, Human
uuggaaggcagacuugggacgcu

SEQ ID NO: 132695 - RNA, 22 nt, Human
ggcucacugcaaccuccaccuc

SEQ ID NO: 132696 - RNA, 22 nt, Human
gacucacugcaaccuccgccuc

SEQ ID NO: 132697 - RNA, 22 nt, Human
ugcagugagcugagauuguguc

SEQ ID NO: 132698 - RNA, 22 nt, Human
uaucuguauuuuuuacaguuau

SEQ ID NO: 132699 - RNA, 26 nt, Human
ccucagcugugggggccucaggcagg

SEQ ID NO: 132700 - RNA, 21 nt, Human
aaacugcacuguuuuauuuua

SEQ ID NO: 132701 - RNA, 22 nt, Human
ugccuauaauccuagcacuuug

SEQ ID NO: 132702 - RNA, 22 nt, Human
ugccuguaaucccagcacuuca

SEQ ID NO: 132703 - RNA, 21 nt, Human
cuccccucagccuccgccgcc

SEQ ID NO: 132704 - RNA, 21 nt, Human
gcucucccucccuucaucauc

SEQ ID NO: 132705 - RNA, 23 nt, Human
cagcgcccaggagccagggcgcu

SEQ ID NO: 132706 - RNA, 25 nt, Human
acccaggcuggagugcaguggguga

SEQ ID NO: 132707 - RNA, 27 nt, Human
cccugcugagccacccggguugggcca

SEQ ID NO: 132708 - RNA, 20 nt, Human
caccuaggcuggagugcagc

SEQ ID NO: 132709 - RNA, 20 nt, Human
auauuuccauuucuuccuca

SEQ ID NO: 132710 - RNA, 26 nt, Human
cccagccugcugccucagcacagcca

SEQ ID NO: 132711 - RNA, 27 nt, Human
accagccuggucaacauugcaaaaccu

SEQ ID NO: 132712 - RNA, 24 nt, Human
cugagccuuccgaguagcugggau

SEQ ID NO: 132713 - RNA, 24 nt, Human
cauggacugugaggucaacaacgg

SEQ ID NO: 132714 - RNA, 24 nt, Human
caguuuuaacacccagcccagugg

SEQ ID NO: 132715 - RNA, 20 nt, Human
cuccacccauccuaucagcc

SEQ ID NO: 132716 - RNA, 26 nt, Human
gcauccugccacccacacagcagccu

SEQ ID NO: 132717 - RNA, 19 nt, Human
accucacagcagcuucgug

SEQ ID NO: 132718 - RNA, 27 nt, Human
auguucagguagcagugagcauuguuc

SEQ ID NO: 132719 - RNA, 25 nt, Human
agggcuguuucauguacuucucucu

SEQ ID NO: 132720 - RNA, 31 nt, Human
caggaagaaagggaaauugcagcuccucagc

SEQ ID NO: 132721 - RNA, 24 nt, Human
uuuuccuaugucauuucugcuuca

SEQ ID NO: 132722 - RNA, 24 nt, Human
cugggagguggucgcccugcagug

SEQ ID NO: 132723 - RNA, 21 nt, Human
cuccucucuguccugccucag

SEQ ID NO: 132724 - RNA, 22 nt, Human
gucuacugcacaagccucggcc

SEQ ID NO: 132725 - RNA, 22 nt, Human
agccucccaaguggcugggacu

SEQ ID NO: 132726 - RNA, 20 nt, Human
gcguuuaucucaggugcgga

SEQ ID NO: 132727 - RNA, 22 nt, Human
cgcugccaggacccaggcacag

SEQ ID NO: 132728 - RNA, 27 nt, Human
cugguccuuggccaggugcaguggcuc

SEQ ID NO: 132729 - RNA, 25 nt, Human
gcuaucucccaugucaucuucaacc

SEQ ID NO: 132730 - RNA, 24 nt, Human
ucuuucucccugauggacagaccc

SEQ ID NO: 132731 - RNA, 25 nt, Human
gaagaauugagggacuuuguagaga

SEQ ID NO: 132732 - RNA, 21 nt, Human
ugccuauaaucccagcacuuu

SEQ ID NO: 132733 - RNA, 20 nt, Human
agaaauuacucaaugcugaa

SEQ ID NO: 132734 - RNA, 20 nt, Human
gacacagccaaccuuuccca

SEQ ID NO: 132735 - RNA, 25 nt, Human
aaagauuugcauaucauuauacuaa

SEQ ID NO: 132736 - RNA, 19 nt, Human
uuugcaggagccuggguga

SEQ ID NO: 132737 - RNA, 25 nt, Human
gcugggagauucaagggacccauga

SEQ ID NO: 132738 - RNA, 20 nt, Human
uucacagugccagccucuac

SEQ ID NO: 132739 - RNA, 29 nt, Human
ggauauccuuggcuucuuugagaauuuaa

SEQ ID NO: 132740 - RNA, 23 nt, Human
gaaggaagaaaaaguguuuuuca

SEQ ID NO: 132741 - RNA, 21 nt, Human
aaauguucuuuaaaggcaucu

SEQ ID NO: 132742 - RNA, 26 nt, Human
ucauuucucauccacauacccugacc

SEQ ID NO: 132743 - RNA, 21 nt, Human
gcggguccaggaucuucggcg

SEQ ID NO: 132744 - RNA, 27 nt, Human
cugggaaaugacagggaaaaugacagg

SEQ ID NO: 132745 - RNA, 21 nt, Human
cccgggucucucacuguugca

SEQ ID NO: 132746 - RNA, 26 nt, Human
gcugaaacuuuuagguccugggagga

SEQ ID NO: 132747 - RNA, 23 nt, Human
acaugcaucugcuauuguguugg

SEQ ID NO: 132748 - RNA, 22 nt, Human
guaugaaccaccgcgcccagcc

SEQ ID NO: 132749 - RNA, 22 nt, Human
gugugagccaccgcacccggcc

SEQ ID NO: 132750 - RNA, 22 nt, Human
gacgagguuucgccauguugcc

SEQ ID NO: 132751 - RNA, 18 nt, Human
uuucugcugcuuggcaca

SEQ ID NO: 132752 - RNA, 26 nt, Human
acaaguguuucuaguaacaguauuuc

SEQ ID NO: 132753 - RNA, 22 nt, Human
aguguagugacgcaugcccuca

SEQ ID NO: 132754 - RNA, 22 nt, Human
acugcaaccuccgccucucggg

SEQ ID NO: 132755 - RNA, 22 nt, Human
auugcaaccuccgccucccggg

SEQ ID NO: 132756 - RNA, 21 nt, Human
uccagccuaggcaacauagug

SEQ ID NO: 132757 - RNA, 23 nt, Human
ucuagguuuuuuccuuucauuuu

SEQ ID NO: 132758 - RNA, 22 nt, Human
acugcuggaacucacacaugcc

SEQ ID NO: 132759 - RNA, 22 nt, Human
ggccucccuaguagcugggauu

SEQ ID NO: 132760 - RNA, 22 nt, Human
agcgggagccucccugccucag

SEQ ID NO: 132761 - RNA, 29 nt, Human
ccccgcaguccaugccucagucggccugc

SEQ ID NO: 132762 - RNA, 22 nt, Human
cuacacucgcucuuucucuccg

SEQ ID NO: 132763 - RNA, 20 nt, Human
cacuccucugcaugucuugg

SEQ ID NO: 132764 - RNA, 25 nt, Human
uucauuuguccacuguuucuuguca

SEQ ID NO: 132765 - RNA, 25 nt, Human
gccggaggggccggagcggagaagc

SEQ ID NO: 132766 - RNA, 20 nt, Human
guccuugaagugaucucuag

SEQ ID NO: 132767 - RNA, 26 nt, Human
ucacucuuguguccaggcuggagugc

SEQ ID NO: 132768 - RNA, 26 nt, Human
aaagaaacaacaaaggaauugaaaca

SEQ ID NO: 132769 - RNA, 21 nt, Human
acgugcugggauuauaggcgu

SEQ ID NO: 132770 - RNA, 20 nt, Human
ggagagggaaguggagcagc

SEQ ID NO: 132771 - RNA, 22 nt, Human
ucuggaagacauuaaugauuga

SEQ ID NO: 132772 - RNA, 17 nt, Human
acaugaucuucuuugag

SEQ ID NO: 132773 - RNA, 23 nt, Human
ccaggagguugagaaugcaguga

SEQ ID NO: 132774 - RNA, 21 nt, Human
gcucacacuccugggcucuga

SEQ ID NO: 132775 - RNA, 27 nt, Human
gaacagcuggcugccaccguuuguguu

SEQ ID NO: 132776 - RNA, 28 nt, Human
uuuuuuaaaauauauacuuccuuaugca

SEQ ID NO: 132777 - RNA, 21 nt, Human
uggaaagccuuacaagacuga

SEQ ID NO: 132778 - RNA, 23 nt, Human
cacucugcuugcuugcuggccgg

SEQ ID NO: 132779 - RNA, 26 nt, Human
gaggggaaagacuuccaucuagucac

SEQ ID NO: 132780 - RNA, 21 nt, Human
gccacugcaauccagccuggg

SEQ ID NO: 132781 - RNA, 21 nt, Human
gacacugcacuccagccuggg

SEQ ID NO: 132782 - RNA, 23 nt, Human
cuggacccuguuuuaccguugcu

SEQ ID NO: 132783 - RNA, 20 nt, Human
ucuaccugcaguuuaauugg

SEQ ID NO: 132784 - RNA, 25 nt, Human
gucacccaggaugcuggggcacuuu

SEQ ID NO: 132785 - RNA, 25 nt, Human
cccaccccacgccuuauccccacuu

SEQ ID NO: 132786 - RNA, 22 nt, Human
cgcugcacuccagccuggguga

SEQ ID NO: 132787 - RNA, 22 nt, Human
cacugcacuccagccugaguga

SEQ ID NO: 132788 - RNA, 24 nt, Human
gggugccuguaaucccagcuacau

SEQ ID NO: 132789 - RNA, 26 nt, Human
cccuccccaaaccccaaggaacucuc

SEQ ID NO: 132790 - RNA, 28 nt, Human
cugagcucuaucaccugagcuccccugc

SEQ ID NO: 132791 - RNA, 20 nt, Human
cagcauuuugggggaacauu

SEQ ID NO: 132792 - RNA, 26 nt, Human
uugcucugucacccaggcuggagcac

SEQ ID NO: 132793 - RNA, 22 nt, Human
agaacaggaccagcugagacua

SEQ ID NO: 132794 - RNA, 19 nt, Human
cacaucuucgcucuggcca

SEQ ID NO: 132795 - RNA, 20 nt, Human
ccaagguggaggcugaggug

SEQ ID NO: 132796 - RNA, 19 nt, Human
caguccugcugccugcuuc

SEQ ID NO: 132797 - RNA, 21 nt, Human
gagugccaggaacacugugga

SEQ ID NO: 132798 - RNA, 24 nt, Human
ccucggcucagcccuauaccaggc

SEQ ID NO: 132799 - RNA, 24 nt, Human
uugaaaacugcaguucccagugcc

SEQ ID NO: 132800 - RNA, 21 nt, Human
acgcugguggaaagacaggga

SEQ ID NO: 132801 - RNA, 19 nt, Human
ccggccuggccacagguga

SEQ ID NO: 132802 - RNA, 23 nt, Human
aauccaaugaaaugaguuuuucu

SEQ ID NO: 132803 - RNA, 27 nt, Human
ccaugauccaucuguguaguuucugaa

SEQ ID NO: 132804 - RNA, 17 nt, Human
uagugcaaguuucucca

SEQ ID NO: 132805 - RNA, 23 nt, Human
ggccgagguaaauacagugaagu

SEQ ID NO: 132806 - RNA, 26 nt, Human
ucacaugcuguucuuuucuaguuaca

SEQ ID NO: 132807 - RNA, 19 nt, Human
ccccuucuaccugccucca

SEQ ID NO: 132808 - RNA, 23 nt, Human
ccuacaccuugcccugccugggc

SEQ ID NO: 132809 - RNA, 27 nt, Human
ccugaccuuggguccugaagugaccuc

SEQ ID NO: 132810 - RNA, 22 nt, Human
ggagagaaguaucagcacccag

SEQ ID NO: 132811 - RNA, 23 nt, Human
gcuucuccagugggaugugcuga

SEQ ID NO: 132812 - RNA, 24 nt, Human
gucaugcaggaugggaucuguggu

SEQ ID NO: 132813 - RNA, 27 nt, Human
aauaagaaagccaggaaucucaggaug

SEQ ID NO: 132814 - RNA, 25 nt, Human
uccaaauacugcuuagcauuuugca

SEQ ID NO: 132815 - RNA, 22 nt, Human
ucugaaaagaagauauuuuuca

SEQ ID NO: 132816 - RNA, 18 nt, Human
aaggcuggagugcaguga

SEQ ID NO: 132817 - RNA, 20 nt, Human
ccugccugugcuccugcugg

SEQ ID NO: 132818 - RNA, 20 nt, Human
gucacccaagagauuguugu

SEQ ID NO: 132819 - RNA, 26 nt, Human
agagaggcagagguggcacaggacag

SEQ ID NO: 132820 - RNA, 21 nt, Human
ucccaagaguaacucucauua

SEQ ID NO: 132821 - RNA, 29 nt, Human
ucugucuguuuagaaucugugcuguguaa

SEQ ID NO: 132822 - RNA, 22 nt, Human
uuggugcauuaaaugaagccuu

SEQ ID NO: 132823 - RNA, 21 nt, Human
uuuucuuuuuuaauuuuugac

SEQ ID NO: 132824 - RNA, 21 nt, Human
auugcuugaaccaggagacgg

SEQ ID NO: 132825 - RNA, 27 nt, Human
cugaucucucuggguaggugcccucug

SEQ ID NO: 132826 - RNA, 18 nt, Human
auacucaacuaaaugcac

SEQ ID NO: 132827 - RNA, 24 nt, Human
gagagaugccuguccugugcuugg

SEQ ID NO: 132828 - RNA, 23 nt, Human
ggggaaaggggaaguaauuggca

SEQ ID NO: 132829 - RNA, 20 nt, Human
augggaaaaaaucuucacca

SEQ ID NO: 132830 - RNA, 22 nt, Human
gcuccaggagaaagcaggcggg

SEQ ID NO: 132831 - RNA, 20 nt, Human
cugugacauucuuuaucccu

SEQ ID NO: 132832 - RNA, 23 nt, Human
ugggugcaauguggguguuuaca

SEQ ID NO: 132833 - RNA, 21 nt, Human
cugaacugcacuacaagacac

SEQ ID NO: 132834 - RNA, 25 nt, Human
acgagagauagaggaugggcagcug

SEQ ID NO: 132835 - RNA, 22 nt, Human
cacccgggcggccagcugggcu

SEQ ID NO: 132836 - RNA, 28 nt, Human
caggaauguggagagcuuccaaaaagag

SEQ ID NO: 132837 - RNA, 29 nt, Human
cagcugaaucuuggcuucuggaccuugac

SEQ ID NO: 132838 - RNA, 21 nt, Human
ccaaugcuccaucccaaccag

SEQ ID NO: 132839 - RNA, 21 nt, Human
gugcgcaaggccagggccaga

SEQ ID NO: 132840 - RNA, 23 nt, Human
cagcagccuggcagcagccucac

SEQ ID NO: 132841 - RNA, 22 nt, Human
ccaccgcgccuggccuauuauu

SEQ ID NO: 132842 - RNA, 22 nt, Human
uugcuucuaaaacaauaaagau

SEQ ID NO: 132843 - RNA, 26 nt, Human
agggacagaggcggggguccuagcug

SEQ ID NO: 132844 - RNA, 20 nt, Human
acucuaaaccuguuauuucu

SEQ ID NO: 132845 - RNA, 22 nt, Human
cucggccucccaaagugauggg

SEQ ID NO: 132846 - RNA, 23 nt, Human
cagugguuguucuguuugugcuu

SEQ ID NO: 132847 - RNA, 26 nt, Human
ggaagugcccagaaugggaggcacgg

SEQ ID NO: 132848 - RNA, 25 nt, Human
ccaaauucaagaagaagcaguauua

SEQ ID NO: 132849 - RNA, 21 nt, Human
ggcucacugaaaccucugccu

SEQ ID NO: 132850 - RNA, 23 nt, Human
uucaguuuguuuacuuuauccaa

SEQ ID NO: 132851 - RNA, 25 nt, Human
agcucaacuugaagcuuucuugccu

SEQ ID NO: 132852 - RNA, 26 nt, Human
aagcgaccgaggcccucccaaagagg

SEQ ID NO: 132853 - RNA, 29 nt, Human
ucuuaccucccagcuaccucucauguggc

SEQ ID NO: 132854 - RNA, 24 nt, Human
uugccucaucaagcagcucagugu

SEQ ID NO: 132855 - RNA, 20 nt, Human
accaucaauuaagacauaua

SEQ ID NO: 132856 - RNA, 26 nt, Human
aucuguguuuucauuuacaucucucu

SEQ ID NO: 132857 - RNA, 28 nt, Human
gagauaauuuaucucacagaagcaccgg

SEQ ID NO: 132858 - RNA, 29 nt, Human
cccugaccuggaaccucugggagggcugc

SEQ ID NO: 132859 - RNA, 23 nt, Human
gggucccuuuugcauugccaagu

SEQ ID NO: 132860 - RNA, 26 nt, Human
augaggcagauagcacugggugugag

SEQ ID NO: 132861 - RNA, 23 nt, Human
aucuaguuucauuucaucuugcu

SEQ ID NO: 132862 - RNA, 22 nt, Human
ugccccugugggucccagggag

SEQ ID NO: 132863 - RNA, 23 nt, Human
ccucaugccaggccccugccucu

SEQ ID NO: 132864 - RNA, 20 nt, Human
cucauucaggagaaugaagu

SEQ ID NO: 132865 - RNA, 24 nt, Human
uucagaugccuaacaccuuccucu

SEQ ID NO: 132866 - RNA, 23 nt, Human
cucuccucuccccauucugugcc

SEQ ID NO: 132867 - RNA, 26 nt, Human
gcauuuucacuccugagaagugcucc

SEQ ID NO: 132868 - RNA, 20 nt, Human
ugagucugucacacucucuu

SEQ ID NO: 132869 - RNA, 20 nt, Human
guuggccaggcuggucucga

SEQ ID NO: 132870 - RNA, 23 nt, Human
uucucuugaauaugcuacacaaa

SEQ ID NO: 132871 - RNA, 23 nt, Human
gagaguguaaauaaauacaucgc

SEQ ID NO: 132872 - RNA, 21 nt, Human
aucaagucccugaauggaagu

SEQ ID NO: 132873 - RNA, 21 nt, Human
aguccugacuuuucuggagcu

SEQ ID NO: 132874 - RNA, 27 nt, Human
cccuccagggggccugccuuucccuga

SEQ ID NO: 132875 - RNA, 21 nt, Human
acaugucucccaucagaaaga

SEQ ID NO: 132876 - RNA, 22 nt, Human
auagucaagacaacacugaccu

SEQ ID NO: 132877 - RNA, 24 nt, Human
caguucugaaacauguggcuaccu

SEQ ID NO: 132878 - RNA, 24 nt, Human
aaauucuuucacuucauuauaugc

SEQ ID NO: 132879 - RNA, 22 nt, Human
uaggaggcggagguugcaguga

SEQ ID NO: 132880 - RNA, 22 nt, Human
cgggaggcggagguugugguga

SEQ ID NO: 132881 - RNA, 22 nt, Human
caggaggcggagguuguaguga

SEQ ID NO: 132882 - RNA, 20 nt, Human
aaaaagaguuuauuuuccau

SEQ ID NO: 132883 - RNA, 26 nt, Human
acaggcagggaaauguuaggagguca

SEQ ID NO: 132884 - RNA, 25 nt, Human
ugguagcaggcaccuguaaucccag

SEQ ID NO: 132885 - RNA, 22 nt, Human
gcgugagccaccaugccccgcc

SEQ ID NO: 132886 - RNA, 27 nt, Human
cacugcauuccagccugugcgacagaa

SEQ ID NO: 132887 - RNA, 27 nt, Human
cgggaaucugggaggcgagcagcucug

SEQ ID NO: 132888 - RNA, 29 nt, Human
uacaugugugccucucacagcaguuggcc

SEQ ID NO: 132889 - RNA, 21 nt, Human
cgacgcuauguccagcaaagg

SEQ ID NO: 132890 - RNA, 18 nt, Human
cccaaaaacaaaucgcag

SEQ ID NO: 132891 - RNA, 24 nt, Human
ugggcuuguuugcagacuggguga

SEQ ID NO: 132892 - RNA, 21 nt, Human
cagggcuggggacagagggug

SEQ ID NO: 132893 - RNA, 22 nt, Human
auuuggcuuauuuuucacugua

SEQ ID NO: 132894 - RNA, 23 nt, Human
uauauucauacauauuauacucu

SEQ ID NO: 132895 - RNA, 24 nt, Human
ggacugcagccuucaucuuuauug

SEQ ID NO: 132896 - RNA, 22 nt, Human
gcaaguguccuaagcuauguca

SEQ ID NO: 132897 - RNA, 19 nt, Human
ugaacucaggaggcagagg

SEQ ID NO: 132898 - RNA, 25 nt, Human
auggacugcucagaaaaaugaggga

SEQ ID NO: 132899 - RNA, 26 nt, Human
gcugggaccacaaaugugagcccacc

SEQ ID NO: 132900 - RNA, 20 nt, Human
ugcccuacucuuugcaccug

SEQ ID NO: 132901 - RNA, 20 nt, Human
cgcccuacuccacugcccug

SEQ ID NO: 132902 - RNA, 21 nt, Human
aaaauacaaaaaguuagccag

SEQ ID NO: 132903 - RNA, 23 nt, Human
acccugugcggggcacaccccca

SEQ ID NO: 132904 - RNA, 27 nt, Human
cgccagguucaaaccuaccggcuuccu

SEQ ID NO: 132905 - RNA, 21 nt, Human
uuuuaguauuaauuauugcuu

SEQ ID NO: 132906 - RNA, 21 nt, Human
gcgcagggggaacccagggag

SEQ ID NO: 132907 - RNA, 21 nt, Human
gaauucaugcagaugccuggc

SEQ ID NO: 132908 - RNA, 23 nt, Human
ccacuccccucuacuugcugcuc

SEQ ID NO: 132909 - RNA, 21 nt, Human
uacugagauccaugugacauu

SEQ ID NO: 132910 - RNA, 22 nt, Human
uaugcuuguaauaaaagcaaag

SEQ ID NO: 132911 - RNA, 26 nt, Human
gcucaauuucuuaggcuggagugcag

SEQ ID NO: 132912 - RNA, 22 nt, Human
cccccuguauucucagcacuuu

SEQ ID NO: 132913 - RNA, 26 nt, Human
caugccuuccguuuggagggccgcgg

SEQ ID NO: 132914 - RNA, 25 nt, Human
gggcaggaaaaaaucuggaauuaac

SEQ ID NO: 132915 - RNA, 31 nt, Human
gcgauucuccugccucagccuccugaguggg

SEQ ID NO: 132916 - RNA, 24 nt, Human
gcuggugggguagggaugagggag

SEQ ID NO: 132917 - RNA, 27 nt, Human
guggggggagagccugagguccccaag

SEQ ID NO: 132918 - RNA, 27 nt, Human
ggagaggccguguagcgucgccguuac

SEQ ID NO: 132919 - RNA, 26 nt, Human
uccacauuccugugcauugagggguu

SEQ ID NO: 132920 - RNA, 21 nt, Human
ccauuucuccucaccugggcc

SEQ ID NO: 132921 - RNA, 21 nt, Human
cagcagaaucaggaucucuuu

SEQ ID NO: 132922 - RNA, 22 nt, Human
gaucgcaccuguaaucccaguc

SEQ ID NO: 132923 - RNA, 24 nt, Human
gcaaacucccuccagacuuugucc

SEQ ID NO: 132924 - RNA, 21 nt, Human
augaaguauaugguucauuag

SEQ ID NO: 132925 - RNA, 22 nt, Human
aacuucagacuuccuguccugc

SEQ ID NO: 132926 - RNA, 26 nt, Human
ucuuugguucuugaauagcuuaguuu

SEQ ID NO: 132927 - RNA, 22 nt, Human
acaaaacaauccccaucaggua

SEQ ID NO: 132928 - RNA, 22 nt, Human
caaagagauggcugauucuggg

SEQ ID NO: 132929 - RNA, 22 nt, Human
ucacaacaggguguugggggug

SEQ ID NO: 132930 - RNA, 30 nt, Human
ggaggaaacaccuccagcccgcgaccuccu

SEQ ID NO: 132931 - RNA, 22 nt, Human
aaacuccugaccucaggcgauc

SEQ ID NO: 132932 - RNA, 24 nt, Human
auggccauuguguugggaccugug

SEQ ID NO: 132933 - RNA, 20 nt, Human
gcucacaucauguaauagug

SEQ ID NO: 132934 - RNA, 27 nt, Human
uacagauauuuacuugguaaagugcag

SEQ ID NO: 132935 - RNA, 23 nt, Human
aggggaggggcgccaggugaggc

SEQ ID NO: 132936 - RNA, 21 nt, Human
uuuguguguacauauuuucca

SEQ ID NO: 132937 - RNA, 27 nt, Human
ccaccaucugcucuaaccauguagacu

SEQ ID NO: 132938 - RNA, 21 nt, Human
ggcggugaggaugcagguccc

SEQ ID NO: 132939 - RNA, 21 nt, Human
uuugucagauucacacaugcc

SEQ ID NO: 132940 - RNA, 23 nt, Human
ucuggggaaaaaggagaaaguga

SEQ ID NO: 132941 - RNA, 22 nt, Human
aguuggaguacuauauuuacaa

SEQ ID NO: 132942 - RNA, 26 nt, Human
cccuccuccucuuucaccuucauaca

SEQ ID NO: 132943 - RNA, 26 nt, Human
caccgcccgggcugggcacuaaacuc

SEQ ID NO: 132944 - RNA, 23 nt, Human
uuuucuuucuuugauguuuugau

SEQ ID NO: 132945 - RNA, 25 nt, Human
uuauuaaaaagauuuuugcugacaa

SEQ ID NO: 132946 - RNA, 20 nt, Human
ugaguguggccaucuguaua

SEQ ID NO: 132947 - RNA, 19 nt, Human
accaacaaauaaacacaug

SEQ ID NO: 132948 - RNA, 20 nt, Human
ggggagggggauaggaagac

SEQ ID NO: 132949 - RNA, 22 nt, Human
gggcaguggccaagccugcugu

SEQ ID NO: 132950 - RNA, 31 nt, Human
agcaaugccauuucaguggcuucccagcucu

SEQ ID NO: 132951 - RNA, 21 nt, Human
aaaccugggcuggagugaggu

SEQ ID NO: 132952 - RNA, 22 nt, Human
gucccaggcuggagugcagugg

SEQ ID NO: 132953 - RNA, 23 nt, Human
uuuggaagcucugaagucacauc

SEQ ID NO: 132954 - RNA, 20 nt, Human
cagacucuuagcugaacgcg

SEQ ID NO: 132955 - RNA, 27 nt, Human
ugaucauagcucacugcagcuucaaac

SEQ ID NO: 132956 - RNA, 20 nt, Human
agccggagaccagaguccag

SEQ ID NO: 132957 - RNA, 22 nt, Human
agcaggacggggacgggagggg

SEQ ID NO: 132958 - RNA, 24 nt, Human
uuuugcccucuuagaaugucccuc

SEQ ID NO: 132959 - RNA, 21 nt, Human
uauaccucauuuccuccauga

SEQ ID NO: 132960 - RNA, 25 nt, Human
ccugucuuccucauguucacacuug

SEQ ID NO: 132961 - RNA, 26 nt, Human
aaagccauaucuagucaauaacucug

SEQ ID NO: 132962 - RNA, 22 nt, Human
acccucccaaguagcugggacu

SEQ ID NO: 132963 - RNA, 22 nt, Human
gaucacaggcgugagccaccgu

SEQ ID NO: 132964 - RNA, 23 nt, Human
cuagaaagagugggagagcagcu

SEQ ID NO: 132965 - RNA, 22 nt, Human
cugacccucacuuuucucaucu

SEQ ID NO: 132966 - RNA, 23 nt, Human
uugccaaggaaacccagagugcc

SEQ ID NO: 132967 - RNA, 24 nt, Human
ggggcccagaacccugggagccag

SEQ ID NO: 132968 - RNA, 27 nt, Human
uggcuuauuccuguaaucccaacacug

SEQ ID NO: 132969 - RNA, 27 nt, Human
gcaaaacuagagccaugucccaagcau

SEQ ID NO: 132970 - RNA, 22 nt, Human
aggcgugccugagaagguagcc

SEQ ID NO: 132971 - RNA, 23 nt, Human
ccugccuguuguuugccuuuugu

SEQ ID NO: 132972 - RNA, 24 nt, Human
ugcuagccauguaaucagauuuau

SEQ ID NO: 132973 - RNA, 22 nt, Human
ggaaagacuuguuaagacacug

SEQ ID NO: 132974 - RNA, 24 nt, Human
ucauucucaggcugggguggacuc

SEQ ID NO: 132975 - RNA, 25 nt, Human
gcagaacgggcaacuacagcucuuu

SEQ ID NO: 132976 - RNA, 22 nt, Human
uaaucagcucaguguguuacug

SEQ ID NO: 132977 - RNA, 19 nt, Human
gcaggacuccagaugagga

SEQ ID NO: 132978 - RNA, 22 nt, Human
caacaucacagagcuccaucug

SEQ ID NO: 132979 - RNA, 23 nt, Human
gcuccuucauuuuacuacuucuu

SEQ ID NO: 132980 - RNA, 23 nt, Human
ccccccagccccuuggcccucuc

SEQ ID NO: 132981 - RNA, 18 nt, Human
ccagcauuucuucauuug

SEQ ID NO: 132982 - RNA, 22 nt, Human
ucuguggacacuggagucugga

SEQ ID NO: 132983 - RNA, 20 nt, Human
gagcugguccaggagccggc

SEQ ID NO: 132984 - RNA, 23 nt, Human
ccucaugccaccacauucgccag

SEQ ID NO: 132985 - RNA, 20 nt, Human
uucagccugugcuucucacu

SEQ ID NO: 132986 - RNA, 22 nt, Human
aacagcacuggcuggggcauuc

SEQ ID NO: 132987 - RNA, 21 nt, Human
auguuuuuaacacuauacucu

SEQ ID NO: 132988 - RNA, 22 nt, Human
cguccuggcccaaggcucucaa

SEQ ID NO: 132989 - RNA, 23 nt, Human
cugagccugguauccauggccgc

SEQ ID NO: 132990 - RNA, 22 nt, Human
gcugaggaugugccugauagug

SEQ ID NO: 132991 - RNA, 24 nt, Human
uccacuaccagccugggccucccc

SEQ ID NO: 132992 - RNA, 22 nt, Human
ucaguguagcuaugugcugcug

SEQ ID NO: 132993 - RNA, 26 nt, Human
cccucggggcucccccggcagcggac

SEQ ID NO: 132994 - RNA, 24 nt, Human
ggaugacaccuccauuucucucca

SEQ ID NO: 132995 - RNA, 22 nt, Human
ugcagugaacugaaauugugcc

SEQ ID NO: 132996 - RNA, 24 nt, Human
guucacuuugcaagagaaaaagaa

SEQ ID NO: 132997 - RNA, 22 nt, Human
cuccccaaauugugacaggaaa

SEQ ID NO: 132998 - RNA, 22 nt, Human
uaguuucucuuagaaaagcuaa

SEQ ID NO: 132999 - RNA, 20 nt, Human
ucguuugauuucaaagcaag

SEQ ID NO: 133000 - RNA, 22 nt, Human
cugggaggcggagcuugcagug

SEQ ID NO: 133001 - RNA, 21 nt, Human
agaguccuggacgcacaauau

SEQ ID NO: 133002 - RNA, 23 nt, Human
gggccagccugagccagcagugg

SEQ ID NO: 133003 - RNA, 22 nt, Human
ugcccaucccaguguccuagga

SEQ ID NO: 133004 - RNA, 21 nt, Human
accuugagguaaagggccagu

SEQ ID NO: 133005 - RNA, 25 nt, Human
aggggugaggcccuggggaggcagg

SEQ ID NO: 133006 - RNA, 22 nt, Human
ggcuugcgcucaggaggcagag

SEQ ID NO: 133007 - RNA, 24 nt, Human
caggaucagcagagcaggcaggca

SEQ ID NO: 133008 - RNA, 27 nt, Human
ccccucggggcugcacuaauggacaga

SEQ ID NO: 133009 - RNA, 23 nt, Human
uaccuuuuaggucuuccuugcaa

SEQ ID NO: 133010 - RNA, 25 nt, Human
gaaguccagggaaaggcaucugguc

SEQ ID NO: 133011 - RNA, 19 nt, Human
uggcaucuugccaccagaa

SEQ ID NO: 133012 - RNA, 25 nt, Human
ggagagggaccgggggucccccagu

SEQ ID NO: 133013 - RNA, 23 nt, Human
cacuugaacgugggaggcagagg

SEQ ID NO: 133014 - RNA, 21 nt, Human
gauguuuuaagauugcaccug

SEQ ID NO: 133015 - RNA, 19 nt, Human
acagaggcagcaucugcca

SEQ ID NO: 133016 - RNA, 20 nt, Human
ccuaagcugaggcaggcggc

SEQ ID NO: 133017 - RNA, 24 nt, Human
ccagcacuuugggaggcugagcug

SEQ ID NO: 133018 - RNA, 16 nt, Human
aggauucugccgccaa

SEQ ID NO: 133019 - RNA, 24 nt, Human
agucaggagaaagccgaaagcugc

SEQ ID NO: 133020 - RNA, 27 nt, Human
ggaagauggcggaucuggaggagcagu

SEQ ID NO: 133021 - RNA, 24 nt, Human
uugcuuuugguaaugugauguuga

SEQ ID NO: 133022 - RNA, 23 nt, Human
ggcaucccucccugcucuucugu

SEQ ID NO: 133023 - RNA, 21 nt, Human
uggccagcagugagccugagc

SEQ ID NO: 133024 - RNA, 20 nt, Human
cccagccuccgacccgaggc

SEQ ID NO: 133025 - RNA, 20 nt, Human
augguagccaggugggugaa

SEQ ID NO: 133026 - RNA, 23 nt, Human
agguauucauauuuaaaugaggg

SEQ ID NO: 133027 - RNA, 19 nt, Human
gucuuugucuucccugaac

SEQ ID NO: 133028 - RNA, 20 nt, Human
cucucaguccaacauuauuu

SEQ ID NO: 133029 - RNA, 22 nt, Human
uguugcccaggcuggagugcag

SEQ ID NO: 133030 - RNA, 22 nt, Human
uguugcccaggcuagagugcaa

SEQ ID NO: 133031 - RNA, 22 nt, Human
ugucgcccaggcuggaguguag

SEQ ID NO: 133032 - RNA, 23 nt, Human
ccucccaucugcaacagaauaca

SEQ ID NO: 133033 - RNA, 25 nt, Human
acagggacucagaaaugugguggga

SEQ ID NO: 133034 - RNA, 20 nt, Human
ugugcucugaugcuacuucu

SEQ ID NO: 133035 - RNA, 22 nt, Human
agguugaggcagcagaauugcu

SEQ ID NO: 133036 - RNA, 21 nt, Human
uuugccuuuaucucugaggcu

SEQ ID NO: 133037 - RNA, 25 nt, Human
ggcuuuucugagauugucuuagggu

SEQ ID NO: 133038 - RNA, 22 nt, Human
auaacacaaaaagcaugaacuu

SEQ ID NO: 133039 - RNA, 32 nt, Human
ggggaguggaagggagcucccagcgcagccgu

SEQ ID NO: 133040 - RNA, 21 nt, Human
aaaacgucuccccugccaaag

SEQ ID NO: 133041 - RNA, 23 nt, Human
cucuccaaauccagccagagaug

SEQ ID NO: 133042 - RNA, 22 nt, Human
aaguacacuauucaggcauauc

SEQ ID NO: 133043 - RNA, 24 nt, Human
cucaucuccuggaaccauggccag

SEQ ID NO: 133044 - RNA, 30 nt, Human
gcacaucuggaugccuucccccaguauguc

SEQ ID NO: 133045 - RNA, 19 nt, Human
uaucauaaaggauauuuca

SEQ ID NO: 133046 - RNA, 25 nt, Human
uugagccaugcguggguggggaggg

SEQ ID NO: 133047 - RNA, 26 nt, Human
cagaaacauuucccagaaaauguuuc

SEQ ID NO: 133048 - RNA, 23 nt, Human
gaggcuuggaccugcuguggagg

SEQ ID NO: 133049 - RNA, 20 nt, Human
accuugcccaugcacaagga

SEQ ID NO: 133050 - RNA, 20 nt, Human
acaugcagagucacauccuc

SEQ ID NO: 133051 - RNA, 21 nt, Human
ccugccugccacccuaggcag

SEQ ID NO: 133052 - RNA, 21 nt, Human
uauccagcagaggggagaaga

SEQ ID NO: 133053 - RNA, 20 nt, Human
aacccaggcuggaaugcaau

SEQ ID NO: 133054 - RNA, 27 nt, Human
auacauacuugguaaacauuuauuuaa

SEQ ID NO: 133055 - RNA, 23 nt, Human
gaacauuuuauuuauacugugaa

SEQ ID NO: 133056 - RNA, 22 nt, Human
acauuugcucuucacagcauga

SEQ ID NO: 133057 - RNA, 20 nt, Human
ugcuuggguuccuuuuucac

SEQ ID NO: 133058 - RNA, 26 nt, Human
agaggcaccuuccacuagcaacaguc

SEQ ID NO: 133059 - RNA, 26 nt, Human
gguaggcugaguauugggaauccaaa

SEQ ID NO: 133060 - RNA, 25 nt, Human
ucugucacccaggcuagagugcagu

SEQ ID NO: 133061 - RNA, 24 nt, Human
aggaaggcgagcagagauauccuc

SEQ ID NO: 133062 - RNA, 25 nt, Human
gagcugggacucagguguuuaaaga

SEQ ID NO: 133063 - RNA, 22 nt, Human
ugcuuguucuguccucuugccu

SEQ ID NO: 133064 - RNA, 21 nt, Human
cacaggagaagcucggacuug

SEQ ID NO: 133065 - RNA, 27 nt, Human
augcucacgccuggaguguuauuuaaa

SEQ ID NO: 133066 - RNA, 28 nt, Human
ucucuuccagagagaggcagcauuggcc

SEQ ID NO: 133067 - RNA, 27 nt, Human
gccaagucagaugguacggacuuccuu

SEQ ID NO: 133068 - RNA, 23 nt, Human
ccucaggcugccccucucuccuc

SEQ ID NO: 133069 - RNA, 21 nt, Human
ugaaaccacagcuuuugugcc

SEQ ID NO: 133070 - RNA, 21 nt, Human
cugucccugagggccuguguu

SEQ ID NO: 133071 - RNA, 22 nt, Human
aaauuuucaaguuuugaaggga

SEQ ID NO: 133072 - RNA, 30 nt, Human
gggguggggguggggguggaagcagccgca

SEQ ID NO: 133073 - RNA, 25 nt, Human
cuaucuacuuuauuaagcaguauug

SEQ ID NO: 133074 - RNA, 21 nt, Human
cuccacccuuuucugagaguu

SEQ ID NO: 133075 - RNA, 20 nt, Human
uccgggcacccauccaucca

SEQ ID NO: 133076 - RNA, 20 nt, Human
cgugugccacuugcccagcu

SEQ ID NO: 133077 - RNA, 24 nt, Human
ugugaugucuucaucauaguauga

SEQ ID NO: 133078 - RNA, 24 nt, Human
uggggguuauuuaaugaaaaacau

SEQ ID NO: 133079 - RNA, 18 nt, Human
uucuaacugguacuccaa

SEQ ID NO: 133080 - RNA, 22 nt, Human
ugggagccaggauacugggguc

SEQ ID NO: 133081 - RNA, 16 nt, Human
acuagaaaaugccuuc

SEQ ID NO: 133082 - RNA, 19 nt, Human
uugcaagcagccuccuggg

SEQ ID NO: 133083 - RNA, 22 nt, Human
uggggcaaggcaaaacuaacuu

SEQ ID NO: 133084 - RNA, 23 nt, Human
ucuugccauguuacccaggcugg

SEQ ID NO: 133085 - RNA, 24 nt, Human
acauagccuucuaaguaaaggcaa

SEQ ID NO: 133086 - RNA, 24 nt, Human
gggcgugggaagagcagggcuugc

SEQ ID NO: 133087 - RNA, 23 nt, Human
cuaaccuccaacacagugcaucu

SEQ ID NO: 133088 - RNA, 27 nt, Human
cucaguuuugcugaauaaucacgugug

SEQ ID NO: 133089 - RNA, 22 nt, Human
ccgggagguggagguugccgug

SEQ ID NO: 133090 - RNA, 21 nt, Human
gacacugaggggaggcaguga

SEQ ID NO: 133091 - RNA, 25 nt, Human
cacugccccggcuggucccaagggu

SEQ ID NO: 133092 - RNA, 20 nt, Human
cucacacaccagggcauucc

SEQ ID NO: 133093 - RNA, 23 nt, Human
ccuccauuuccauuuauucucaa

SEQ ID NO: 133094 - RNA, 24 nt, Human
ugcccugccuggaguucccccugg

SEQ ID NO: 133095 - RNA, 27 nt, Human
cacaaguguccagagaucguagccaga

SEQ ID NO: 133096 - RNA, 22 nt, Human
ucaugccauucugccucagccu

SEQ ID NO: 133097 - RNA, 20 nt, Human
gauuccacucucuuccacga

SEQ ID NO: 133098 - RNA, 26 nt, Human
cccagaacugacuucaaaggcagcuu

SEQ ID NO: 133099 - RNA, 23 nt, Human
ucagcacuugggcccacugacag

SEQ ID NO: 133100 - RNA, 24 nt, Human
gcuaugguuuucuccaagagcuac

SEQ ID NO: 133101 - RNA, 23 nt, Human
ggaagagggguuaaggugcagug

SEQ ID NO: 133102 - RNA, 28 nt, Human
ucuuccuuucuuuuuccucucuaagccu

SEQ ID NO: 133103 - RNA, 27 nt, Human
ccccacccuccuugagacuggagcuga

SEQ ID NO: 133104 - RNA, 22 nt, Human
cuucaggugauccacccgccuc

SEQ ID NO: 133105 - RNA, 22 nt, Human
ugggugagggccuggagaugug

SEQ ID NO: 133106 - RNA, 27 nt, Human
ucccagccacagcuagaggucccgggc

SEQ ID NO: 133107 - RNA, 28 nt, Human
cccucagauuauuuuuccucuggcuccu

SEQ ID NO: 133108 - RNA, 27 nt, Human
ucacacucuccaggcuggagugcagug

SEQ ID NO: 133109 - RNA, 27 nt, Human
uugcccaggcuggagggcaauggugca

SEQ ID NO: 133110 - RNA, 21 nt, Human
ccuggacugaggcgcgcuggg

SEQ ID NO: 133111 - RNA, 20 nt, Human
agaggcacacaugugcugca

SEQ ID NO: 133112 - RNA, 24 nt, Human
ccuggagacccuggaaguggugug

SEQ ID NO: 133113 - RNA, 23 nt, Human
ccuuggcuccugggggcagccag

SEQ ID NO: 133114 - RNA, 22 nt, Human
cacaagguggcagcaagcaauu

SEQ ID NO: 133115 - RNA, 26 nt, Human
ucugccucuggccgcggccuguggga

SEQ ID NO: 133116 - RNA, 27 nt, Human
ccgguguucagugguuucccugcccga

SEQ ID NO: 133117 - RNA, 26 nt, Human
accauucugaauucucuaaagggaaa

SEQ ID NO: 133118 - RNA, 22 nt, Human
cauagcuuuuggcugggggcgg

SEQ ID NO: 133119 - RNA, 21 nt, Human
gccuggcugccccaaacccca

SEQ ID NO: 133120 - RNA, 21 nt, Human
cagcggccgaaggccauucgg

SEQ ID NO: 133121 - RNA, 25 nt, Human
uagccuggaugcccaccccugcugc

SEQ ID NO: 133122 - RNA, 22 nt, Human
uggaacagugaggaauggaggc

SEQ ID NO: 133123 - RNA, 23 nt, Human
ucaagaaugaaguaaauacaguc

SEQ ID NO: 133124 - RNA, 26 nt, Human
ggcaguauguaguuauuuauuacaaa

SEQ ID NO: 133125 - RNA, 23 nt, Human
ucuugggucuacauuuuagggaa

SEQ ID NO: 133126 - RNA, 23 nt, Human
uacugcccuccgucuacaggccu

SEQ ID NO: 133127 - RNA, 24 nt, Human
gucugccucuuuggucaguuucag

SEQ ID NO: 133128 - RNA, 22 nt, Human
gcuucucugugaauugccugua

SEQ ID NO: 133129 - RNA, 20 nt, Human
ccucucucacucugccuuca

SEQ ID NO: 133130 - RNA, 21 nt, Human
gugcagccucuaacuccuggg

SEQ ID NO: 133131 - RNA, 22 nt, Human
cuugcauuucaaaaugguaacu

SEQ ID NO: 133132 - RNA, 18 nt, Human
guauuuucccugcccuca

SEQ ID NO: 133133 - RNA, 22 nt, Human
gauugcacuccagccugggcga

SEQ ID NO: 133134 - RNA, 22 nt, Human
gaucgcacuccagccuggguga

SEQ ID NO: 133135 - RNA, 22 nt, Human
ucagccaggcuggagugcagug

SEQ ID NO: 133136 - RNA, 23 nt, Human
cauucugccagcuuucugauguu

SEQ ID NO: 133137 - RNA, 26 nt, Human
gcacagagaugcauacacaggugccu

SEQ ID NO: 133138 - RNA, 27 nt, Human
ggacucugagcgggaggcagaguuugc

SEQ ID NO: 133139 - RNA, 21 nt, Human
ccacagaaaauuucuucaaaa

SEQ ID NO: 133140 - RNA, 24 nt, Human
ccuacagacuugcugugugaccuc

SEQ ID NO: 133141 - RNA, 27 nt, Human
ggccucagauacugaagauuauuuuug

SEQ ID NO: 133142 - RNA, 23 nt, Human
guugcccaggcugggagggcaau

SEQ ID NO: 133143 - RNA, 20 nt, Human
ccccucgacuggaggcaggg

SEQ ID NO: 133144 - RNA, 25 nt, Human
cccacucccuuccccauagauaggc

SEQ ID NO: 133145 - RNA, 21 nt, Human
aggcuggagugcaguggcgcg

SEQ ID NO: 133146 - RNA, 22 nt, Human
ggccucccaaagcacugggauu

SEQ ID NO: 133147 - RNA, 22 nt, Human
gaccaggcuggagugcaguggu

SEQ ID NO: 133148 - RNA, 24 nt, Human
accccuucccuguccuugcccuuu

SEQ ID NO: 133149 - RNA, 25 nt, Human
guguuuuuaucacaccugcucccca

SEQ ID NO: 133150 - RNA, 26 nt, Human
ugugcuuucugcuacacugcuaguuu

SEQ ID NO: 133151 - RNA, 26 nt, Human
acagaaguccagccaguuuccaggua

SEQ ID NO: 133152 - RNA, 21 nt, Human
aaccuguaaucccagcacuuu

SEQ ID NO: 133153 - RNA, 21 nt, Human
ugcugcccugcccuugugacc

SEQ ID NO: 133154 - RNA, 21 nt, Human
cugcaccccuucucuccuggg

SEQ ID NO: 133155 - RNA, 28 nt, Human
cacuuuguccuagcaucuuucuggaauc

SEQ ID NO: 133156 - RNA, 18 nt, Human
aguguaaguuucugucag

SEQ ID NO: 133157 - RNA, 22 nt, Human
aggugucagaucagaauuuuua

SEQ ID NO: 133158 - RNA, 27 nt, Human
uggcauccuugaucucagggaucuucu

SEQ ID NO: 133159 - RNA, 22 nt, Human
cgggggcagccagugcccagcc

SEQ ID NO: 133160 - RNA, 28 nt, Human
ucauccagagcuggagugcagcggcaca

SEQ ID NO: 133161 - RNA, 22 nt, Human
ccugcagcagagccaacaugcc

SEQ ID NO: 133162 - RNA, 30 nt, Human
ccuggccccuugcuguucccaagugcacga

SEQ ID NO: 133163 - RNA, 29 nt, Human
cagucuugcguguggauggugcagccacc

SEQ ID NO: 133164 - RNA, 27 nt, Human
gucgcccaggcuggagugcaaugccgu

SEQ ID NO: 133165 - RNA, 22 nt, Human
cuacuuuuuauacuccauacau

SEQ ID NO: 133166 - RNA, 20 nt, Human
auauuccugccuuucuucca

SEQ ID NO: 133167 - RNA, 20 nt, Human
uauauacaucucuauuucuc

SEQ ID NO: 133168 - RNA, 27 nt, Human
guggcaccuccagacacccugaaacua

SEQ ID NO: 133169 - RNA, 22 nt, Human
caaggagguguucaaggcugcc

SEQ ID NO: 133170 - RNA, 22 nt, Human
ugcauccugccuaggcuggacu

SEQ ID NO: 133171 - RNA, 16 nt, Human
aaacccagggguucua

SEQ ID NO: 133172 - RNA, 21 nt, Human
gcuggggcccaaguaagggca

SEQ ID NO: 133173 - RNA, 21 nt, Human
ggcaaguugcagagauggugg

SEQ ID NO: 133174 - RNA, 22 nt, Human
accagccuggacaacacaguga

SEQ ID NO: 133175 - RNA, 22 nt, Human
gagauggcuucuggaggaaggc

SEQ ID NO: 133176 - RNA, 26 nt, Human
aagccuccucugaauggcuuugugaa

SEQ ID NO: 133177 - RNA, 27 nt, Human
agacagccacaccuuaguauacugccc

SEQ ID NO: 133178 - RNA, 21 nt, Human
cucuugaacuccugaccucag

SEQ ID NO: 133179 - RNA, 20 nt, Human
aauaaccaaaugcaauguga

SEQ ID NO: 133180 - RNA, 22 nt, Human
ccccagacucucagcaucugcu

SEQ ID NO: 133181 - RNA, 27 nt, Human
gagccugagugacagagcaagacccca

SEQ ID NO: 133182 - RNA, 19 nt, Human
gccuccagccacuuauuuc

SEQ ID NO: 133183 - RNA, 27 nt, Human
guuguuguguugagauccagugcaguu

SEQ ID NO: 133184 - RNA, 23 nt, Human
agcggaguggauggcagaggugg

SEQ ID NO: 133185 - RNA, 20 nt, Human
ccacccaccaccgcucccgc

SEQ ID NO: 133186 - RNA, 24 nt, Human
agggcagauggcagaggaucugcc

SEQ ID NO: 133187 - RNA, 17 nt, Human
augaucccuuuucuccc

SEQ ID NO: 133188 - RNA, 22 nt, Human
ugacucaggccagugugucucu

SEQ ID NO: 133189 - RNA, 22 nt, Human
aacuagucugcagauguuucuu

SEQ ID NO: 133190 - RNA, 21 nt, Human
aucuucagucagauuauccuc

SEQ ID NO: 133191 - RNA, 21 nt, Human
agugggccaccaucacccacc

SEQ ID NO: 133192 - RNA, 22 nt, Human
aacaacagauguacgacuugca

SEQ ID NO: 133193 - RNA, 21 nt, Human
uugacagcuggaguggcaaaa

SEQ ID NO: 133194 - RNA, 23 nt, Human
aucaugauauucagaaaaaucca

SEQ ID NO: 133195 - RNA, 20 nt, Human
ggcuggucaucaccuaccca

SEQ ID NO: 133196 - RNA, 22 nt, Human
ugaaauccugggcucaagugau

SEQ ID NO: 133197 - RNA, 27 nt, Human
ugcugggacccggaaggcgggcgcucc

SEQ ID NO: 133198 - RNA, 20 nt, Human
acagagaccucucuucugga

SEQ ID NO: 133199 - RNA, 23 nt, Human
agcagcaccagcugcucucuuuc

SEQ ID NO: 133200 - RNA, 28 nt, Human
aaugaauucuucaacagggaaaacagcu

SEQ ID NO: 133201 - RNA, 22 nt, Human
uccauuucucccugucuguccc

SEQ ID NO: 133202 - RNA, 21 nt, Human
gacacaaaaugaauauuaaug

SEQ ID NO: 133203 - RNA, 21 nt, Human
cauccaugcuguuguguguau

SEQ ID NO: 133204 - RNA, 25 nt, Human
uaguaguuaaguguuaagacugcuu

SEQ ID NO: 133205 - RNA, 25 nt, Human
cuucugcugauucccgagcaccaac

SEQ ID NO: 133206 - RNA, 26 nt, Human
aaaaacacuggcacuugaauguugaa

SEQ ID NO: 133207 - RNA, 22 nt, Human
uguuauaucagcagacacucca

SEQ ID NO: 133208 - RNA, 23 nt, Human
cagccucaguccacuuaccugaa

SEQ ID NO: 133209 - RNA, 23 nt, Human
uaccucacacccaaagcauuuug

SEQ ID NO: 133210 - RNA, 26 nt, Human
cuguuccuuucucugggcuuaggguc

SEQ ID NO: 133211 - RNA, 21 nt, Human
aaaucacucacaagcaaucca

SEQ ID NO: 133212 - RNA, 16 nt, Human
uuucccuuacccaccu

SEQ ID NO: 133213 - RNA, 22 nt, Human
gacuuuuuauaauugaaccucc

SEQ ID NO: 133214 - RNA, 27 nt, Human
acugccauugccgccuccugccaccag

SEQ ID NO: 133215 - RNA, 24 nt, Human
ccuaccaauacauugcacaggguu

SEQ ID NO: 133216 - RNA, 23 nt, Human
ccaagcccuguguccccaaggag

SEQ ID NO: 133217 - RNA, 18 nt, Human
gcaggugccaucacgcuu

SEQ ID NO: 133218 - RNA, 22 nt, Human
uugcucuucagcuccuuccugu

SEQ ID NO: 133219 - RNA, 22 nt, Human
acuucugggcccuaggcugcuu

SEQ ID NO: 133220 - RNA, 22 nt, Human
gugggugggucaucugagguca

SEQ ID NO: 133221 - RNA, 27 nt, Human
uuggugauucaaaguguuguguuccug

SEQ ID NO: 133222 - RNA, 26 nt, Human
cacagcuucagcuauacuuacacugu

SEQ ID NO: 133223 - RNA, 20 nt, Human
accuaccucaaagggcaguu

SEQ ID NO: 133224 - RNA, 21 nt, Human
acccuuuaaugaacuuaucug

SEQ ID NO: 133225 - RNA, 26 nt, Human
ucauuucuuaucaucacuuuuugucu

SEQ ID NO: 133226 - RNA, 25 nt, Human
acugaaauacauuaaugugggugau

SEQ ID NO: 133227 - RNA, 25 nt, Human
ccaugcacacgggugcucuccuuuu

SEQ ID NO: 133228 - RNA, 20 nt, Human
gacgggaucgcuuucuccca

SEQ ID NO: 133229 - RNA, 24 nt, Human
ccagcugagaggugguagagcagg

SEQ ID NO: 133230 - RNA, 24 nt, Human
ggauaccacucucucagccacaga

SEQ ID NO: 133231 - RNA, 25 nt, Human
cgggagcgcaagaugcgggagcagc

SEQ ID NO: 133232 - RNA, 25 nt, Human
caaccaaggagcuaucuagcucugg

SEQ ID NO: 133233 - RNA, 19 nt, Human
acacaaauuugguugggag

SEQ ID NO: 133234 - RNA, 21 nt, Human
cuuuuucuuugaaguuuuagc

SEQ ID NO: 133235 - RNA, 28 nt, Human
uugugcucuguauugcaggucuaccccg

SEQ ID NO: 133236 - RNA, 17 nt, Human
cugccucuaaaaggccu

SEQ ID NO: 133237 - RNA, 20 nt, Human
cucucagucuuucauucaua

SEQ ID NO: 133238 - RNA, 22 nt, Human
augacugcauggauagaaccac

SEQ ID NO: 133239 - RNA, 25 nt, Human
uuccaggcauccaucuuggaagaaa

SEQ ID NO: 133240 - RNA, 23 nt, Human
uugagacagagucucgcucuguc

SEQ ID NO: 133241 - RNA, 20 nt, Human
agauucccagagggccaggu

SEQ ID NO: 133242 - RNA, 23 nt, Human
aaaugucccuccaacacagaucc

SEQ ID NO: 133243 - RNA, 14 nt, Human
gccucucccugccc

SEQ ID NO: 133244 - RNA, 28 nt, Human
uaagaagcuaagaaaauauuucuuagca

SEQ ID NO: 133245 - RNA, 21 nt, Human
cguucagagaacagugucccu

SEQ ID NO: 133246 - RNA, 21 nt, Human
gcaacacucugcggaccugcc

SEQ ID NO: 133247 - RNA, 23 nt, Human
uuuaaaacaaaaaguuguuacgg

SEQ ID NO: 133248 - RNA, 23 nt, Human
uuuccucuucagccugccugggg

SEQ ID NO: 133249 - RNA, 21 nt, Human
uugcuaccuaugugcccgguu

SEQ ID NO: 133250 - RNA, 22 nt, Human
uuaguaaaaauaaauguuuuua

SEQ ID NO: 133251 - RNA, 23 nt, Human
cuccacccguuuucuagaguucu

SEQ ID NO: 133252 - RNA, 28 nt, Human
gugggggaggagcacaaaacuccagccc

SEQ ID NO: 133253 - RNA, 26 nt, Human
uguguacccauacugcagccccaucc

SEQ ID NO: 133254 - RNA, 22 nt, Human
gcccagccuguuuuuauaaacu

SEQ ID NO: 133255 - RNA, 23 nt, Human
aaccuacuucuuauuuacuccaa

SEQ ID NO: 133256 - RNA, 25 nt, Human
cccugcucccagccugcugagagcc

SEQ ID NO: 133257 - RNA, 19 nt, Human
uuucauuguacaguuuaca

SEQ ID NO: 133258 - RNA, 29 nt, Human
uaaugcaauuagucugucacuccauuugg

SEQ ID NO: 133259 - RNA, 24 nt, Human
ccaucugauuuacuuaauucaguc

SEQ ID NO: 133260 - RNA, 26 nt, Human
agaacuccuguggggaggaaaccuua

SEQ ID NO: 133261 - RNA, 25 nt, Human
ugagacuacuaagaggcauggcccc

SEQ ID NO: 133262 - RNA, 19 nt, Human
auacggaucauuuguauuu

SEQ ID NO: 133263 - RNA, 21 nt, Human
ccuaccucuguucugccuguc

SEQ ID NO: 133264 - RNA, 19 nt, Human
uggucucauguugaccuua

SEQ ID NO: 133265 - RNA, 22 nt, Human
cccuccaguccccauggauugg

SEQ ID NO: 133266 - RNA, 22 nt, Human
aaguauauuguaaaauacauau

SEQ ID NO: 133267 - RNA, 23 nt, Human
uuccaauaauuaagaauacuuca

SEQ ID NO: 133268 - RNA, 22 nt, Human
gcuuuuguugccggguggaccc

SEQ ID NO: 133269 - RNA, 26 nt, Human
cucgagugcugagauuacacacguga

SEQ ID NO: 133270 - RNA, 21 nt, Human
caucggaaggcagcacuggau

SEQ ID NO: 133271 - RNA, 20 nt, Human
ccucuucuuuucccugcugc

SEQ ID NO: 133272 - RNA, 25 nt, Human
cuggcuuuuacccuugaccuguguc

SEQ ID NO: 133273 - RNA, 22 nt, Human
gcuuucccuucccuucuuuaua

SEQ ID NO: 133274 - RNA, 23 nt, Human
gcgggugggaaauggcggaguau

SEQ ID NO: 133275 - RNA, 23 nt, Human
uugggccucugcuucucucaccu

SEQ ID NO: 133276 - RNA, 27 nt, Human
cacacacaaccuccccuguuuucacau

SEQ ID NO: 133277 - RNA, 23 nt, Human
aggguggagugcaguggcaugau

SEQ ID NO: 133278 - RNA, 24 nt, Human
uuugcaaagucacagaccauugcc

SEQ ID NO: 133279 - RNA, 23 nt, Human
ccauucucccugacagggagucc

SEQ ID NO: 133280 - RNA, 20 nt, Human
gccugccagaaaagucacua

SEQ ID NO: 133281 - RNA, 23 nt, Human
caugcuagagaggagcucauugg

SEQ ID NO: 133282 - RNA, 22 nt, Human
ucuuuccuuccuaagggaccuu

SEQ ID NO: 133283 - RNA, 23 nt, Human
ucucaaacucccgaccucaggug

SEQ ID NO: 133284 - RNA, 22 nt, Human
cgcuccccucccucuccacucg

SEQ ID NO: 133285 - RNA, 19 nt, Human
agccaggcuggagucagug

SEQ ID NO: 133286 - RNA, 22 nt, Human
gcguuuucugaagaagugggag

SEQ ID NO: 133287 - RNA, 19 nt, Human
gcgggaaaagcacgugucc

SEQ ID NO: 133288 - RNA, 22 nt, Human
agccuccugaguagcugggaug

SEQ ID NO: 133289 - RNA, 20 nt, Human
cugggagauagucccagggg

SEQ ID NO: 133290 - RNA, 20 nt, Human
cagcucguccaaaggcuuca

SEQ ID NO: 133291 - RNA, 24 nt, Human
ucuccucccaaaauacuacacauc

SEQ ID NO: 133292 - RNA, 23 nt, Human
cuguugguaaccaggaguauaag

SEQ ID NO: 133293 - RNA, 20 nt, Human
cuguaggaucagggucuaag

SEQ ID NO: 133294 - RNA, 22 nt, Human
agucucacuuuguucagcugcc

SEQ ID NO: 133295 - RNA, 26 nt, Human
cuccaaugucugggacuugccagcuc

SEQ ID NO: 133296 - RNA, 17 nt, Human
acugucucccccuuguc

SEQ ID NO: 133297 - RNA, 22 nt, Human
cggaguuucgcucugucgccca

SEQ ID NO: 133298 - RNA, 25 nt, Human
ucuaccauuuuuaauuuaugguuca

SEQ ID NO: 133299 - RNA, 22 nt, Human
uuugaaauaggugaggcagggu

SEQ ID NO: 133300 - RNA, 22 nt, Human
ggucucaaagaagcaguggcca

SEQ ID NO: 133301 - RNA, 27 nt, Human
ugaccaacauggagaaaccccgucucu

SEQ ID NO: 133302 - RNA, 22 nt, Human
uuugaagaagaaaaggugcuua

SEQ ID NO: 133303 - RNA, 22 nt, Human
ucuagcuauagugucucgagua

SEQ ID NO: 133304 - RNA, 25 nt, Human
ggccuuuucucacgacucuugucuc

SEQ ID NO: 133305 - RNA, 21 nt, Human
gcauuucagcuacaucaugcc

SEQ ID NO: 133306 - RNA, 22 nt, Human
gcccccagcaaccaccaaucug

SEQ ID NO: 133307 - RNA, 26 nt, Human
aggaaaaucauuucagaugcaguguu

SEQ ID NO: 133308 - RNA, 21 nt, Human
aggauuccacagaucacauac

SEQ ID NO: 133309 - RNA, 19 nt, Human
uauccagcacucaccauga

SEQ ID NO: 133310 - RNA, 24 nt, Human
ccucugcagucuuuacacccacag

SEQ ID NO: 133311 - RNA, 23 nt, Human
gggccuggccuugcaaccucuuu

SEQ ID NO: 133312 - RNA, 21 nt, Human
aacuccuccccaccccaacaa

SEQ ID NO: 133313 - RNA, 27 nt, Human
ccccugccucucacagcagcacccuuu

SEQ ID NO: 133314 - RNA, 30 nt, Human
ccugugcacuguccuggcccccucuuauuu

SEQ ID NO: 133315 - RNA, 26 nt, Human
cucugucuaaaaaacaaaacaaaaca

SEQ ID NO: 133316 - RNA, 24 nt, Human
gguggcuuauauuuucagcaaaga

SEQ ID NO: 133317 - RNA, 27 nt, Human
gggcagccccuccccauggugcaguga

SEQ ID NO: 133318 - RNA, 24 nt, Human
uuucuaguuccauguuucuuuucu

SEQ ID NO: 133319 - RNA, 23 nt, Human
gaggucagggcauuucuuauccc

SEQ ID NO: 133320 - RNA, 19 nt, Human
uuuucucauggggaaggau

SEQ ID NO: 133321 - RNA, 17 nt, Human
gaaacaacagaaacuuu

SEQ ID NO: 133322 - RNA, 22 nt, Human
uggcugcagacuggagcugcgc

SEQ ID NO: 133323 - RNA, 22 nt, Human
agcuuccccaguagcugggacc

SEQ ID NO: 133324 - RNA, 22 nt, Human
gaacccgggacgcagagguuac

SEQ ID NO: 133325 - RNA, 22 nt, Human
ugcagugagcgaagaucgagcc

SEQ ID NO: 133326 - RNA, 24 nt, Human
acacaaauauuuaagaggaaagag

SEQ ID NO: 133327 - RNA, 27 nt, Human
aggcagccggcacccacaagugccacu

SEQ ID NO: 133328 - RNA, 26 nt, Human
ugagcagaucuguggaagaacaaucc

SEQ ID NO: 133329 - RNA, 25 nt, Human
uucccugcaagacugagcggcgggg

SEQ ID NO: 133330 - RNA, 26 nt, Human
cucucgaacuccuagccucaagcaau

SEQ ID NO: 133331 - RNA, 19 nt, Human
ucugaacucuaccuccaga

SEQ ID NO: 133332 - RNA, 21 nt, Human
aacugauguuccaugcauguu

SEQ ID NO: 133333 - RNA, 21 nt, Human
augcccaggcuugaugggaua

SEQ ID NO: 133334 - RNA, 25 nt, Human
uuaccuuucucuccaaguucuccca

SEQ ID NO: 133335 - RNA, 22 nt, Human
caggaggucuguguugucaugg

SEQ ID NO: 133336 - RNA, 20 nt, Human
aaccaucagagaaucuagaa

SEQ ID NO: 133337 - RNA, 21 nt, Human
ugguugaaugauagcauuuca

SEQ ID NO: 133338 - RNA, 27 nt, Human
ggaacgccuuccaggaaccuguggacu

SEQ ID NO: 133339 - RNA, 26 nt, Human
cuggguccccuaucacaaggcuacug

SEQ ID NO: 133340 - RNA, 26 nt, Human
aaauguucauuguuuaauuagcacug

SEQ ID NO: 133341 - RNA, 27 nt, Human
agagcaucaccuuuucccuuucauguu

SEQ ID NO: 133342 - RNA, 21 nt, Human
aucauacuuaucauaauguuc

SEQ ID NO: 133343 - RNA, 21 nt, Human
caggucagaagccagagccag

SEQ ID NO: 133344 - RNA, 22 nt, Human
aucaugggauuuaaauuuauca

SEQ ID NO: 133345 - RNA, 30 nt, Human
ggacaucgggacggaggcagacguggucgu

SEQ ID NO: 133346 - RNA, 19 nt, Human
ccugcauuuuccucuuguc

SEQ ID NO: 133347 - RNA, 23 nt, Human
uguuguuucguuuucuagcuaua

SEQ ID NO: 133348 - RNA, 26 nt, Human
uaucagacuauauucuaaaacuauau

SEQ ID NO: 133349 - RNA, 21 nt, Human
ggaaguggagacugcagugag

SEQ ID NO: 133350 - RNA, 26 nt, Human
cugucuucucccugcacaagccaggg

SEQ ID NO: 133351 - RNA, 30 nt, Human
uucagacaugcucauaccauucccauuuuc

SEQ ID NO: 133352 - RNA, 26 nt, Human
cugccucugacucgcuguguacccuc

SEQ ID NO: 133353 - RNA, 23 nt, Human
uugcccaguguguuucugaucug

SEQ ID NO: 133354 - RNA, 27 nt, Human
uuuuaaauaacauuuaggguguguuuu

SEQ ID NO: 133355 - RNA, 21 nt, Human
agaaauuuuuaaacuggaaag

SEQ ID NO: 133356 - RNA, 30 nt, Human
uugggccggguuggggguugcuagaaggcg

SEQ ID NO: 133357 - RNA, 24 nt, Human
caggaccuguuccagugggcacug

SEQ ID NO: 133358 - RNA, 25 nt, Human
gcugcugcugccuccccaccgccuu

SEQ ID NO: 133359 - RNA, 24 nt, Human
caguuuugaauaaaagcauuuaca

SEQ ID NO: 133360 - RNA, 22 nt, Human
ucuguucccuggaggccagucc

SEQ ID NO: 133361 - RNA, 28 nt, Human
uccuggcucucccggggcgggcgcagau

SEQ ID NO: 133362 - RNA, 22 nt, Human
ucuucuuuaugucuaccuccuc

SEQ ID NO: 133363 - RNA, 22 nt, Human
cugaggcaggagacuagcugga

SEQ ID NO: 133364 - RNA, 22 nt, Human
ccagccaucugcacuuguacca

SEQ ID NO: 133365 - RNA, 20 nt, Human
caacuauucacccuaccuca

SEQ ID NO: 133366 - RNA, 22 nt, Human
gcagccaggagcagcagccgcg

SEQ ID NO: 133367 - RNA, 22 nt, Human
gccuugugcauguccauaguga

SEQ ID NO: 133368 - RNA, 29 nt, Human
gcugagcccuggccgccuccuggcuggaa

SEQ ID NO: 133369 - RNA, 25 nt, Human
acaaaccugaauguggccguguuca

SEQ ID NO: 133370 - RNA, 19 nt, Human
guggugaguggaucauuuc

SEQ ID NO: 133371 - RNA, 22 nt, Human
ucugcugcccaggcuagagugc

SEQ ID NO: 133372 - RNA, 21 nt, Human
guaauuaggcugaguugggug

SEQ ID NO: 133373 - RNA, 24 nt, Human
ucuacuucaaaccuuccucuagca

SEQ ID NO: 133374 - RNA, 22 nt, Human
ucauuccucuguucuuauuggg

SEQ ID NO: 133375 - RNA, 21 nt, Human
gacccuccccacccugaacaa

SEQ ID NO: 133376 - RNA, 21 nt, Human
cgggaggcggagguuccagug

SEQ ID NO: 133377 - RNA, 22 nt, Human
agcugggcaaaggagaaauaug

SEQ ID NO: 133378 - RNA, 26 nt, Human
caccuugccacccauucuucccguuc

SEQ ID NO: 133379 - RNA, 22 nt, Human
aaauguucuuuaaaggcaucua

SEQ ID NO: 133380 - RNA, 20 nt, Human
ccuccauggacaccuagcca

SEQ ID NO: 133381 - RNA, 22 nt, Human
caggaguuuaaagcugcagugc

SEQ ID NO: 133382 - RNA, 21 nt, Human
gauuuuucuguucauuuauuu

SEQ ID NO: 133383 - RNA, 23 nt, Human
ggcucugcuccucccugggccug

SEQ ID NO: 133384 - RNA, 32 nt, Human
gugccugcccaugccagcacuuccuuaaguuc

SEQ ID NO: 133385 - RNA, 19 nt, Human
aagaacugcuucaugugaa

SEQ ID NO: 133386 - RNA, 18 nt, Human
aaacccgcaucugcucac

SEQ ID NO: 133387 - RNA, 29 nt, Human
gaccagaaggccugcuguaaucaguguga

SEQ ID NO: 133388 - RNA, 22 nt, Human
cgggagauggcgcuugcaguga

SEQ ID NO: 133389 - RNA, 20 nt, Human
ccaaggcuucccagagcgaa

SEQ ID NO: 133390 - RNA, 21 nt, Human
ugccuaacuucccuagagaaa

SEQ ID NO: 133391 - RNA, 24 nt, Human
aggccugauuuuaaacuucaggcc

SEQ ID NO: 133392 - RNA, 25 nt, Human
cugguauacuaucauccuggagggg

SEQ ID NO: 133393 - RNA, 28 nt, Human
aucauacugaaguagagugcggcguuuc

SEQ ID NO: 133394 - RNA, 19 nt, Human
ugcucacucagcugcccug

SEQ ID NO: 133395 - RNA, 21 nt, Human
ggacccuucggcucaccaaga

SEQ ID NO: 133396 - RNA, 22 nt, Human
cccagaucuuagcuggcagguc

SEQ ID NO: 133397 - RNA, 19 nt, Human
cuggcaccuggcgcgcucg

SEQ ID NO: 133398 - RNA, 26 nt, Human
ccagaagagggaccugggaguccugg

SEQ ID NO: 133399 - RNA, 26 nt, Human
cccugccuugccccugcacuaugcuc

SEQ ID NO: 133400 - RNA, 20 nt, Human
agauucuugugauacaauca

SEQ ID NO: 133401 - RNA, 22 nt, Human
ugguggagccagacagagcagg

SEQ ID NO: 133402 - RNA, 22 nt, Human
auaggcaauguaguacucagua

SEQ ID NO: 133403 - RNA, 22 nt, Human
gggcccaggagguggagguugc

SEQ ID NO: 133404 - RNA, 19 nt, Human
augccuggccuuaggcugu

SEQ ID NO: 133405 - RNA, 22 nt, Human
caguaaauauuauugguuguug

SEQ ID NO: 133406 - RNA, 22 nt, Human
gauaccacucucucagccacag

SEQ ID NO: 133407 - RNA, 23 nt, Human
ugucauucaggcuggagugcagu

SEQ ID NO: 133408 - RNA, 21 nt, Human
uguggaaucccagagcuacuc

SEQ ID NO: 133409 - RNA, 26 nt, Human
ucucccacucucucuguuuuuuauag

SEQ ID NO: 133410 - RNA, 21 nt, Human
cagaaagagguugcugcaguu

SEQ ID NO: 133411 - RNA, 26 nt, Human
uugcucuuucgccaaggcuggagugc

SEQ ID NO: 133412 - RNA, 21 nt, Human
uguaugccacaccuggccuua

SEQ ID NO: 133413 - RNA, 22 nt, Human
ggucuucccucucccugccuca

SEQ ID NO: 133414 - RNA, 21 nt, Human
ucagucucacauuucucaaca

SEQ ID NO: 133415 - RNA, 22 nt, Human
uuauuuuucuccacugcuugga

SEQ ID NO: 133416 - RNA, 26 nt, Human
agcaaggacaugcggccugcauggug

SEQ ID NO: 133417 - RNA, 23 nt, Human
ccucucacagccuaggugcucug

SEQ ID NO: 133418 - RNA, 26 nt, Human
acaggcaaucaacaaacguuucuuga

SEQ ID NO: 133419 - RNA, 18 nt, Human
ggaccacuaaaugcugaa

SEQ ID NO: 133420 - RNA, 23 nt, Human
uuugcauaugaugccagccucac

SEQ ID NO: 133421 - RNA, 22 nt, Human
gggggagggggagggcacaggc

SEQ ID NO: 133422 - RNA, 23 nt, Human
ggccugacagcucuguggccugg

SEQ ID NO: 133423 - RNA, 21 nt, Human
aagcaagaggcuucaagguuu

SEQ ID NO: 133424 - RNA, 25 nt, Human
cuccgucuccaaaaacaaacaaaca

SEQ ID NO: 133425 - RNA, 21 nt, Human
gaagagcuaggguagagaagg

SEQ ID NO: 133426 - RNA, 22 nt, Human
cugcaaccucugcccccugggu

SEQ ID NO: 133427 - RNA, 22 nt, Human
cugcaaucucugccuccugggu

SEQ ID NO: 133428 - RNA, 20 nt, Human
gccaugguggugugcaccug

SEQ ID NO: 133429 - RNA, 26 nt, Human
gguucugccuguggcuauuugcuaca

SEQ ID NO: 133430 - RNA, 23 nt, Human
gucacccaggaugcuggggcacu

SEQ ID NO: 133431 - RNA, 23 nt, Human
accuguaaaucccagcacuuugg

SEQ ID NO: 133432 - RNA, 23 nt, Human
ggaguuguugaacuauauuugga

SEQ ID NO: 133433 - RNA, 17 nt, Human
cugccuauuuaaagaca

SEQ ID NO: 133434 - RNA, 22 nt, Human
uuuagacuuacuauuacauaaa

SEQ ID NO: 133435 - RNA, 21 nt, Human
uugcugccacauggcgaccgc

SEQ ID NO: 133436 - RNA, 32 nt, Human
cacacuucuagucgcgggagcugcaggucuua

SEQ ID NO: 133437 - RNA, 21 nt, Human
uuggacucugucacaaaggga

SEQ ID NO: 133438 - RNA, 17 nt, Human
cugcggaaugaaccaca

SEQ ID NO: 133439 - RNA, 21 nt, Human
ucuagauuugacccaaucaua

SEQ ID NO: 133440 - RNA, 22 nt, Human
gcucacaccuguaaucccagaa

SEQ ID NO: 133441 - RNA, 22 nt, Human
guugguguguuuuugggauguc

SEQ ID NO: 133442 - RNA, 20 nt, Human
aacucacugcagugcucuuc

SEQ ID NO: 133443 - RNA, 22 nt, Human
ggggugaggaaacugcgacugg

SEQ ID NO: 133444 - RNA, 24 nt, Human
acuugcuggcugacagacucaguc

SEQ ID NO: 133445 - RNA, 21 nt, Human
uacaggcaggugucucauaug

SEQ ID NO: 133446 - RNA, 23 nt, Human
uuuugcaucuuuacuuguggagc

SEQ ID NO: 133447 - RNA, 23 nt, Human
ucuggcagagcugagaagggcag

SEQ ID NO: 133448 - RNA, 23 nt, Human
ggacagugagagcagggcuuggc

SEQ ID NO: 133449 - RNA, 24 nt, Human
uccugguugagaagcaacgagggc

SEQ ID NO: 133450 - RNA, 23 nt, Human
augacauuaaggaaaguucugcu

SEQ ID NO: 133451 - RNA, 20 nt, Human
uccaacaaauaauaauguaa

SEQ ID NO: 133452 - RNA, 26 nt, Human
gaaucaggagccuggacacugccauc

SEQ ID NO: 133453 - RNA, 22 nt, Human
guuuugacuacuagagcuccau

SEQ ID NO: 133454 - RNA, 19 nt, Human
agcuuaucaugcugucuuu

SEQ ID NO: 133455 - RNA, 22 nt, Human
ccggggcauggacagggccagg

SEQ ID NO: 133456 - RNA, 22 nt, Human
cugcaaacgcugccugccggua

SEQ ID NO: 133457 - RNA, 26 nt, Human
ugcccagagacaagugaaggugucug

SEQ ID NO: 133458 - RNA, 27 nt, Human
ccccacuggucuagccaucaugacacc

SEQ ID NO: 133459 - RNA, 22 nt, Human
agcccaggcuggagugcagugg

SEQ ID NO: 133460 - RNA, 21 nt, Human
guaaagcacaggaaaccaggc

SEQ ID NO: 133461 - RNA, 25 nt, Human
caccaggcuggagugcaguggugca

SEQ ID NO: 133462 - RNA, 22 nt, Human
cuccugccggcagcuccaacca

SEQ ID NO: 133463 - RNA, 20 nt, Human
caggcuggauuguacgggcc

SEQ ID NO: 133464 - RNA, 18 nt, Human
gguagugcgugccuguga

SEQ ID NO: 133465 - RNA, 22 nt, Human
uccucccuaguguuccuccccg

SEQ ID NO: 133466 - RNA, 20 nt, Human
augagugugugugagguaua

SEQ ID NO: 133467 - RNA, 20 nt, Human
ugaggccacagagugccuug

SEQ ID NO: 133468 - RNA, 26 nt, Human
ucuggcuuuugcuuuccugcuagugu

SEQ ID NO: 133469 - RNA, 22 nt, Human
auaucugcuuggagaaccacaa

SEQ ID NO: 133470 - RNA, 21 nt, Human
gccagugcuuuauuuggggaa

SEQ ID NO: 133471 - RNA, 18 nt, Human
guuuuguuccccuccucc

SEQ ID NO: 133472 - RNA, 23 nt, Human
caggaggugcagcguguggagug

SEQ ID NO: 133473 - RNA, 18 nt, Human
uccaugacaaguuuuugg

SEQ ID NO: 133474 - RNA, 21 nt, Human
guaugcagaauguuguugguu

SEQ ID NO: 133475 - RNA, 24 nt, Human
cccugggauggaaccucaggaugg

SEQ ID NO: 133476 - RNA, 22 nt, Human
ggcggggguccaggcagaaaga

SEQ ID NO: 133477 - RNA, 21 nt, Human
gcuguuaccuuucccugcuga

SEQ ID NO: 133478 - RNA, 22 nt, Human
gagcaagacucugucucaaaag

SEQ ID NO: 133479 - RNA, 30 nt, Human
ggcuuauggguuaauaaaugaauucaugga

SEQ ID NO: 133480 - RNA, 25 nt, Human
aguugcaguccacagcauucacauu

SEQ ID NO: 133481 - RNA, 19 nt, Human
caggcagcucaagcagcga

SEQ ID NO: 133482 - RNA, 27 nt, Human
gcccagccucuguggcccuguggccug

SEQ ID NO: 133483 - RNA, 21 nt, Human
cagggcugacucucauccuuc

SEQ ID NO: 133484 - RNA, 26 nt, Human
aauggacugaggaaugcuuguucuag

SEQ ID NO: 133485 - RNA, 22 nt, Human
uucauaccuacauguauuuguu

SEQ ID NO: 133486 - RNA, 27 nt, Human
ucuagcuccucuccaaacagccaugcc

SEQ ID NO: 133487 - RNA, 27 nt, Human
caagagagauuagaauaucugguuucu

SEQ ID NO: 133488 - RNA, 22 nt, Human
ggccugguccuggaacugagcc

SEQ ID NO: 133489 - RNA, 23 nt, Human
caugccugcgccugcugccugcu

SEQ ID NO: 133490 - RNA, 21 nt, Human
ggcuucucgagggcuuggggg

SEQ ID NO: 133491 - RNA, 25 nt, Human
cgcacacacagugauucccuccucc

SEQ ID NO: 133492 - RNA, 27 nt, Human
caggcuggagugcaguggcacgaucuu

SEQ ID NO: 133493 - RNA, 22 nt, Human
guucccuaggggacacuucccu

SEQ ID NO: 133494 - RNA, 26 nt, Human
acucacaaguuucugagcccuuuguc

SEQ ID NO: 133495 - RNA, 22 nt, Human
ggggaaagggagaaggguggua

SEQ ID NO: 133496 - RNA, 22 nt, Human
acguugggacagggagguguga

SEQ ID NO: 133497 - RNA, 23 nt, Human
gucuccuaagcuggagugcagug

SEQ ID NO: 133498 - RNA, 22 nt, Human
cgcuugaacccgggaggcggag

SEQ ID NO: 133499 - RNA, 21 nt, Human
uaaagagccuacaguguccuu

SEQ ID NO: 133500 - RNA, 28 nt, Human
ccccgugccucugcuucccaagaugcca

SEQ ID NO: 133501 - RNA, 22 nt, Human
ccucgccugccccugccuuggc

SEQ ID NO: 133502 - RNA, 29 nt, Human
auugcuuucucucuggccuggacauucuc

SEQ ID NO: 133503 - RNA, 22 nt, Human
cuaagccccaaggcccggagug

SEQ ID NO: 133504 - RNA, 23 nt, Human
gcuucauucuguacauagcucuu

SEQ ID NO: 133505 - RNA, 22 nt, Human
ugccccuucaggguuuggagga

SEQ ID NO: 133506 - RNA, 22 nt, Human
ugagccuuuuaguagagcugau

SEQ ID NO: 133507 - RNA, 24 nt, Human
ggccuccugaguagcuaagggagg

SEQ ID NO: 133508 - RNA, 27 nt, Human
ccccagguuccuccuuccccucccgau

SEQ ID NO: 133509 - RNA, 22 nt, Human
auucagcccuuugauagcuuuu

SEQ ID NO: 133510 - RNA, 19 nt, Human
agcuggauccccacgugag

SEQ ID NO: 133511 - RNA, 27 nt, Human
cacugcacuccagccugggcaacagau

SEQ ID NO: 133512 - RNA, 21 nt, Human
gugacugccaaaaaggaguau

SEQ ID NO: 133513 - RNA, 22 nt, Human
cgucaagccuuucaccuuccuc

SEQ ID NO: 133514 - RNA, 23 nt, Human
uccaguauuuugauaguuaauua

SEQ ID NO: 133515 - RNA, 20 nt, Human
cggguagugcauuuugucac

SEQ ID NO: 133516 - RNA, 22 nt, Human
guguaugcccaccacaaagaag

SEQ ID NO: 133517 - RNA, 27 nt, Human
cuggagugugguggcacgaucacagcu

SEQ ID NO: 133518 - RNA, 23 nt, Human
cccaggagguggagguugcagua

SEQ ID NO: 133519 - RNA, 24 nt, Human
gcugaacacauuuacucucuggca

SEQ ID NO: 133520 - RNA, 20 nt, Human
cuguauuuaugaaauacuca

SEQ ID NO: 133521 - RNA, 23 nt, Human
gaaaaccugucacuugcacagag

SEQ ID NO: 133522 - RNA, 28 nt, Human
ucugaggagcagcuucaguccccgccga

SEQ ID NO: 133523 - RNA, 29 nt, Human
ggcccagcuggcuggaguccaggcagcca

SEQ ID NO: 133524 - RNA, 23 nt, Human
cuaccugccuuauacuacacuua

SEQ ID NO: 133525 - RNA, 21 nt, Human
ggaugccuacuuggaaccugg

SEQ ID NO: 133526 - RNA, 23 nt, Human
uggugugucauuugugaaaauag

SEQ ID NO: 133527 - RNA, 23 nt, Human
cucacgcccagccuccucccacc

SEQ ID NO: 133528 - RNA, 18 nt, Human
ucagcacucugcagugag

SEQ ID NO: 133529 - RNA, 22 nt, Human
ccggguagcugggacuacaggc

SEQ ID NO: 133530 - RNA, 22 nt, Human
ccgaguagcugagacuacaggc

SEQ ID NO: 133531 - RNA, 24 nt, Human
cagaagcagaaagccugcugggga

SEQ ID NO: 133532 - RNA, 21 nt, Human
aaacuggagugcaguggcaca

SEQ ID NO: 133533 - RNA, 18 nt, Human
uuacagugucaguuucca

SEQ ID NO: 133534 - RNA, 26 nt, Human
auaggagaggaugagagcccagaggu

SEQ ID NO: 133535 - RNA, 25 nt, Human
ugugugccgagccugccuguguccu

SEQ ID NO: 133536 - RNA, 28 nt, Human
cuucaaaaugagcccuguccugccuaag

SEQ ID NO: 133537 - RNA, 21 nt, Human
cgcuggggaucccggaccucg

SEQ ID NO: 133538 - RNA, 21 nt, Human
aggaagcugugcggagcugug

SEQ ID NO: 133539 - RNA, 27 nt, Human
aaucaucaaaauaaaccuuugugaauu

SEQ ID NO: 133540 - RNA, 26 nt, Human
gugaagccacaugggguuucaguugc

SEQ ID NO: 133541 - RNA, 22 nt, Human
gugugcaugugugugcaggggu

SEQ ID NO: 133542 - RNA, 25 nt, Human
caggcagccuugcucuggcuggugg

SEQ ID NO: 133543 - RNA, 24 nt, Human
ccucuccugaccccugccuguugg

SEQ ID NO: 133544 - RNA, 21 nt, Human
gucugucccugucuugguguu

SEQ ID NO: 133545 - RNA, 21 nt, Human
cagccaggcuggagugcagug

SEQ ID NO: 133546 - RNA, 26 nt, Human
gggccugcgcaguccugguccuggcu

SEQ ID NO: 133547 - RNA, 22 nt, Human
gaauuguuuccuucacagcuau

SEQ ID NO: 133548 - RNA, 20 nt, Human
cuccccggaagggggagaga

SEQ ID NO: 133549 - RNA, 18 nt, Human
uuccuuucgcagccaguc

SEQ ID NO: 133550 - RNA, 21 nt, Human
gugcaaaagccaaacaucuug

SEQ ID NO: 133551 - RNA, 29 nt, Human
ugcuuacccaaaaaagggaacacuguggu

SEQ ID NO: 133552 - RNA, 19 nt, Human
cuugcagauauguguggca

SEQ ID NO: 133553 - RNA, 20 nt, Human
ucuccaggaguuggggcucc

SEQ ID NO: 133554 - RNA, 22 nt, Human
guuuaaauaccuaucacugugg

SEQ ID NO: 133555 - RNA, 22 nt, Human
uguucugcaauauccugcagcu

SEQ ID NO: 133556 - RNA, 21 nt, Human
cccaacaaucucuguugccag

SEQ ID NO: 133557 - RNA, 26 nt, Human
gggucacauguccacccugaccaauc

SEQ ID NO: 133558 - RNA, 19 nt, Human
uaugcacacacauaaacgg

SEQ ID NO: 133559 - RNA, 23 nt, Human
gagggaaaugggacaggggccgu

SEQ ID NO: 133560 - RNA, 19 nt, Human
ggaggcugaggggggauca

SEQ ID NO: 133561 - RNA, 26 nt, Human
gcccugccugugaagcucuuguuucu

SEQ ID NO: 133562 - RNA, 20 nt, Human
uggauucucuuagcuacugu

SEQ ID NO: 133563 - RNA, 20 nt, Human
ggcaugagaccagugugagg

SEQ ID NO: 133564 - RNA, 27 nt, Human
uacccuuugaccaaaugucuuucucug

SEQ ID NO: 133565 - RNA, 27 nt, Human
gugugcuuucugcuacacugcuaguuu

SEQ ID NO: 133566 - RNA, 24 nt, Human
cuacccagaccuuguuuuuuguug

SEQ ID NO: 133567 - RNA, 21 nt, Human
uaaagugcugggaucacaggc

SEQ ID NO: 133568 - RNA, 22 nt, Human
guaugcuuuuauaggccugugu

SEQ ID NO: 133569 - RNA, 25 nt, Human
caguuucagcgcuggcucuucgugc

SEQ ID NO: 133570 - RNA, 22 nt, Human
gugaggcucgcggcacagcguu

SEQ ID NO: 133571 - RNA, 22 nt, Human
gauuagaggcgugugccaccau

SEQ ID NO: 133572 - RNA, 18 nt, Human
gcugcucuacugcuucag

SEQ ID NO: 133573 - RNA, 23 nt, Human
acaugugugcaugugugugcaca

SEQ ID NO: 133574 - RNA, 22 nt, Human
aucuugauuagauuagauuaga

SEQ ID NO: 133575 - RNA, 20 nt, Human
gugccaggcuggaggcggca

SEQ ID NO: 133576 - RNA, 21 nt, Human
cgggaguggagcuugcaauga

SEQ ID NO: 133577 - RNA, 22 nt, Human
cuucugcuccggcuguuucacu

SEQ ID NO: 133578 - RNA, 21 nt, Human
gggagcugggaacaggaauga

SEQ ID NO: 133579 - RNA, 25 nt, Human
gcacacgugcacauucauguguaca

SEQ ID NO: 133580 - RNA, 20 nt, Human
gccauggccuuccucuccug

SEQ ID NO: 133581 - RNA, 20 nt, Human
cuucucccugggaacugguu

SEQ ID NO: 133582 - RNA, 21 nt, Human
ugacaguguugaaaauguuca

SEQ ID NO: 133583 - RNA, 25 nt, Human
ugguggcacgugccuguaaucccag

SEQ ID NO: 133584 - RNA, 22 nt, Human
gcguauguuuguguauaaggua

SEQ ID NO: 133585 - RNA, 20 nt, Human
guguaacauccaagccagag

SEQ ID NO: 133586 - RNA, 20 nt, Human
cccagccucagcugcugucc

SEQ ID NO: 133587 - RNA, 22 nt, Human
uuucuugccagcuugggccauu

SEQ ID NO: 133588 - RNA, 24 nt, Human
ucuucucucacauggagaaaacca

SEQ ID NO: 133589 - RNA, 20 nt, Human
cacaugcucacuggugaaca

SEQ ID NO: 133590 - RNA, 22 nt, Human
gcaaagggagagaggggcaagc

SEQ ID NO: 133591 - RNA, 22 nt, Human
ccacugugccuggccuuaugua

SEQ ID NO: 133592 - RNA, 22 nt, Human
uguagcucuggcccagugggaa

SEQ ID NO: 133593 - RNA, 27 nt, Human
gugaacaagaaacaugaaaucugcuuc

SEQ ID NO: 133594 - RNA, 21 nt, Human
ggcaaauucacuuuuuacuca

SEQ ID NO: 133595 - RNA, 23 nt, Human
ccugguucuauuaaaauauccau

SEQ ID NO: 133596 - RNA, 22 nt, Human
caucugaagaaaauucaucagu

SEQ ID NO: 133597 - RNA, 26 nt, Human
gcuccucugcaucaugugaggagggc

SEQ ID NO: 133598 - RNA, 30 nt, Human
agccuuuccccuccccuccacuucuugggu

SEQ ID NO: 133599 - RNA, 20 nt, Human
cuugaugugugagcagcagc

SEQ ID NO: 133600 - RNA, 22 nt, Human
acccuugagaagaacugacaca

SEQ ID NO: 133601 - RNA, 26 nt, Human
ugggcagcuuuucugcuuuuucccuu

SEQ ID NO: 133602 - RNA, 23 nt, Human
cuguguaccuaguacacaggcau

SEQ ID NO: 133603 - RNA, 21 nt, Human
aggaggcggagguugcaguga

SEQ ID NO: 133604 - RNA, 22 nt, Human
ccaggagguggaaacugcagag

SEQ ID NO: 133605 - RNA, 19 nt, Human
uaggaaggggaaauaucug

SEQ ID NO: 133606 - RNA, 26 nt, Human
agggugaggguuccuguuuggauuag

SEQ ID NO: 133607 - RNA, 23 nt, Human
gcucacugcaaccucugccuacc

SEQ ID NO: 133608 - RNA, 26 nt, Human
cugcugucuguugaugacgugugugc

SEQ ID NO: 133609 - RNA, 30 nt, Human
ccggccccuggccccugccugcccucuaga

SEQ ID NO: 133610 - RNA, 24 nt, Human
acuuggauuucugaucaguguugc

SEQ ID NO: 133611 - RNA, 20 nt, Human
ucugaaacaaugagaaaaau

SEQ ID NO: 133612 - RNA, 24 nt, Human
ggagaggggcauuucuagagcagu

SEQ ID NO: 133613 - RNA, 22 nt, Human
cauuuucuuucuucucuuuuug

SEQ ID NO: 133614 - RNA, 22 nt, Human
cugccccucagcuccgcugguc

SEQ ID NO: 133615 - RNA, 20 nt, Human
gcuuuucucaugacugugug

SEQ ID NO: 133616 - RNA, 22 nt, Human
gagaauugguccuggaagggaa

SEQ ID NO: 133617 - RNA, 27 nt, Human
cucucauuccuucccacagaauggauu

SEQ ID NO: 133618 - RNA, 22 nt, Human
cggaguguugcucugucaccca

SEQ ID NO: 133619 - RNA, 24 nt, Human
gcaccgccagccgccugggcacgg

SEQ ID NO: 133620 - RNA, 21 nt, Human
ccuguuucagcugcuacuuca

SEQ ID NO: 133621 - RNA, 27 nt, Human
aacaaauuugcugggagagggaaagac

SEQ ID NO: 133622 - RNA, 22 nt, Human
uagcaaagcaaaccugcuuuga

SEQ ID NO: 133623 - RNA, 22 nt, Human
ugcuccacuuccagaagccagg

SEQ ID NO: 133624 - RNA, 20 nt, Human
aguugaauuguuuucugccu

SEQ ID NO: 133625 - RNA, 20 nt, Human
guuaucaugcagaauugggu

SEQ ID NO: 133626 - RNA, 22 nt, Human
gccuguaauuccagcauguugg

SEQ ID NO: 133627 - RNA, 21 nt, Human
uugaccaggcuggagugaagu

SEQ ID NO: 133628 - RNA, 23 nt, Human
gaucccaaaguuaguuacucuua

SEQ ID NO: 133629 - RNA, 23 nt, Human
ggcccucgggaaguuccgcgucc

SEQ ID NO: 133630 - RNA, 20 nt, Human
agcccauaggccacccccua

SEQ ID NO: 133631 - RNA, 23 nt, Human
gcauggaggagaaugaccccaag

SEQ ID NO: 133632 - RNA, 17 nt, Human
ccugccugccacaugcc

SEQ ID NO: 133633 - RNA, 23 nt, Human
acauuaaaauucucagaggacuu

SEQ ID NO: 133634 - RNA, 20 nt, Human
acucuguccgcccaggcugg

SEQ ID NO: 133635 - RNA, 21 nt, Human
uucugaggucagaguggaccc

SEQ ID NO: 133636 - RNA, 22 nt, Human
uucuccguguuggucaggcugg

SEQ ID NO: 133637 - RNA, 21 nt, Human
cuccuagucacuuucuuucuc

SEQ ID NO: 133638 - RNA, 24 nt, Human
ggcgaggcagaggacagaucaaug

SEQ ID NO: 133639 - RNA, 23 nt, Human
ucacugcaaccuccaacucccug

SEQ ID NO: 133640 - RNA, 23 nt, Human
agucccuucucucuuccuugcuu

SEQ ID NO: 133641 - RNA, 23 nt, Human
cugcuucucugucuccgagaccg

SEQ ID NO: 133642 - RNA, 24 nt, Human
ggcugugcaucagugggaucccag

SEQ ID NO: 133643 - RNA, 23 nt, Human
gcucccacucuaagaagucuccc

SEQ ID NO: 133644 - RNA, 22 nt, Human
cuaaacacaguucucaguggca

SEQ ID NO: 133645 - RNA, 21 nt, Human
ggccucggaccagccauuucg

SEQ ID NO: 133646 - RNA, 27 nt, Human
cuugacgcgagaggcucugagggucug

SEQ ID NO: 133647 - RNA, 23 nt, Human
cgugccuggugagucugccugug

SEQ ID NO: 133648 - RNA, 22 nt, Human
gcagugucuguuucccauguca

SEQ ID NO: 133649 - RNA, 25 nt, Human
gccuguaauuaaacuaguuuaaggg

SEQ ID NO: 133650 - RNA, 19 nt, Human
ggucccuggcugcugaggg

SEQ ID NO: 133651 - RNA, 21 nt, Human
gguaguucaucuucccucgau

SEQ ID NO: 133652 - RNA, 32 nt, Human
gacuuaaccuuuuauuuccuguccuuccuuga

SEQ ID NO: 133653 - RNA, 22 nt, Human
uuuuaugcuggacucuggacca

SEQ ID NO: 133654 - RNA, 26 nt, Human
guggguggugggcaaggugggaccuc

SEQ ID NO: 133655 - RNA, 22 nt, Human
cuaguugaagugcuauuaugag

SEQ ID NO: 133656 - RNA, 20 nt, Human
uaucccccaguauuuuccau

SEQ ID NO: 133657 - RNA, 27 nt, Human
ggacggccccacgacagagggagucag

SEQ ID NO: 133658 - RNA, 26 nt, Human
cucuuccuccaaggcuggagugcagu

SEQ ID NO: 133659 - RNA, 25 nt, Human
ggcucucuucuuucuuccucauccu

SEQ ID NO: 133660 - RNA, 23 nt, Human
cgcagcccuggcugacugcacgg

SEQ ID NO: 133661 - RNA, 24 nt, Human
ucuguuggauucaugucuuuugcu

SEQ ID NO: 133662 - RNA, 27 nt, Human
uucugaccuggguucugggacuuuuaa

SEQ ID NO: 133663 - RNA, 22 nt, Human
gacaaaugugguuacacacuuu

SEQ ID NO: 133664 - RNA, 20 nt, Human
accaccucagaaaggauuuu

SEQ ID NO: 133665 - RNA, 22 nt, Human
cuucaaaaggauuucaggcuga

SEQ ID NO: 133666 - RNA, 27 nt, Human
ucguggcgacucgagcuccuggaacuu

SEQ ID NO: 133667 - RNA, 23 nt, Human
gccaugucacuggucauugugug

SEQ ID NO: 133668 - RNA, 26 nt, Human
agugaaggcaggauuggaaccccagg

SEQ ID NO: 133669 - RNA, 28 nt, Human
cugacuucuugcuggccuguggagggug

SEQ ID NO: 133670 - RNA, 21 nt, Human
gcugcugucuuggugccuguc

SEQ ID NO: 133671 - RNA, 22 nt, Human
uuguguucucuccuuuucucuc

SEQ ID NO: 133672 - RNA, 23 nt, Human
ccagacucaacugccaccagucc

SEQ ID NO: 133673 - RNA, 26 nt, Human
cuaaaauguuagagcagaauucauua

SEQ ID NO: 133674 - RNA, 26 nt, Human
cccagcaauuccucguaggugugugu

SEQ ID NO: 133675 - RNA, 18 nt, Human
cacagcacagaugccauc

SEQ ID NO: 133676 - RNA, 26 nt, Human
accugacagagcccuggcuuugaccu

SEQ ID NO: 133677 - RNA, 21 nt, Human
uuggggaaggcagguccugag

SEQ ID NO: 133678 - RNA, 20 nt, Human
uggagcaaaaauucccacug

SEQ ID NO: 133679 - RNA, 23 nt, Human
agucaagcaaccacagucuguua

SEQ ID NO: 133680 - RNA, 21 nt, Human
caccaaaaagaaagaaacccu

SEQ ID NO: 133681 - RNA, 22 nt, Human
gaccagccuccgggaagggguc

SEQ ID NO: 133682 - RNA, 24 nt, Human
uucaauacaaccauaggcucacag

SEQ ID NO: 133683 - RNA, 20 nt, Human
guugggucucugugcggacg

SEQ ID NO: 133684 - RNA, 23 nt, Human
cccaggagguggaggcugcggug

SEQ ID NO: 133685 - RNA, 21 nt, Human
aggagguggagguugcaguga

SEQ ID NO: 133686 - RNA, 23 nt, Human
cuucccuuagccucucccacccg

SEQ ID NO: 133687 - RNA, 27 nt, Human
gucucaaacuccugggcucaagcgauc

SEQ ID NO: 133688 - RNA, 23 nt, Human
cucccagggacccuccacgacca

SEQ ID NO: 133689 - RNA, 26 nt, Human
aaacuauucaugcuagcauuuuucca

SEQ ID NO: 133690 - RNA, 23 nt, Human
gcugcugcaggauggaguggaaa

SEQ ID NO: 133691 - RNA, 19 nt, Human
aacucugcccaugugucag

SEQ ID NO: 133692 - RNA, 24 nt, Human
uggccucucuggcugggugcagug

SEQ ID NO: 133693 - RNA, 22 nt, Human
ccaaguagcugggacugcaggc

SEQ ID NO: 133694 - RNA, 21 nt, Human
gccuauggggaguuacuccaa

SEQ ID NO: 133695 - RNA, 27 nt, Human
cagaucacaaacuccuagagucuacau

SEQ ID NO: 133696 - RNA, 22 nt, Human
gacugagucauuacaguggacc

SEQ ID NO: 133697 - RNA, 20 nt, Human
ccuaagcugcuccaaccucc

SEQ ID NO: 133698 - RNA, 25 nt, Human
ucccagccauggccuuccucuccug

SEQ ID NO: 133699 - RNA, 21 nt, Human
cccuuucugcccuccugcucc

SEQ ID NO: 133700 - RNA, 22 nt, Human
aaagaaaguaaugccacacauu

SEQ ID NO: 133701 - RNA, 16 nt, Human
cagagagaaauuugua

SEQ ID NO: 133702 - RNA, 15 nt, Human
caaucuacacugccu

SEQ ID NO: 133703 - RNA, 25 nt, Human
gaggcuggacagcugcaugcagccu

SEQ ID NO: 133704 - RNA, 26 nt, Human
cccucccguccaccuccucuguaaca

SEQ ID NO: 133705 - RNA, 22 nt, Human
ccggcagccuugcucaguucag

SEQ ID NO: 133706 - RNA, 28 nt, Human
agccucaguccccagcagagccuguguc

SEQ ID NO: 133707 - RNA, 22 nt, Human
ugccugcuguuccugacuacag

SEQ ID NO: 133708 - RNA, 22 nt, Human
uuuguauauacacacugcagca

SEQ ID NO: 133709 - RNA, 19 nt, Human
uuauuacaguuucucuacu

SEQ ID NO: 133710 - RNA, 23 nt, Human
gucucuuguaguuucauuccuug

SEQ ID NO: 133711 - RNA, 21 nt, Human
uucucaugcuauuucuaccuc

SEQ ID NO: 133712 - RNA, 26 nt, Human
gugacuucuuaucugaaauuuugcua

SEQ ID NO: 133713 - RNA, 21 nt, Human
aucaacccucuccugucugcc

SEQ ID NO: 133714 - RNA, 24 nt, Human
ucucccaccucugucugcccgcug

SEQ ID NO: 133715 - RNA, 22 nt, Human
ccuccacuucucuccuaggcaa

SEQ ID NO: 133716 - RNA, 21 nt, Human
agaacaauggcuauucaugug

SEQ ID NO: 133717 - RNA, 26 nt, Human
gagggaggggaaauguaauacuggaa

SEQ ID NO: 133718 - RNA, 23 nt, Human
uccauuauuuucaauggaagucc

SEQ ID NO: 133719 - RNA, 20 nt, Human
caacuguccaucaggugagg

SEQ ID NO: 133720 - RNA, 25 nt, Human
ccaauacacacagcuccauuaugca

SEQ ID NO: 133721 - RNA, 20 nt, Human
guugcuguuuggucugguga

SEQ ID NO: 133722 - RNA, 19 nt, Human
ggacccuuccaugggagga

SEQ ID NO: 133723 - RNA, 22 nt, Human
caucagguuccaguugcuugaa

SEQ ID NO: 133724 - RNA, 20 nt, Human
gaaucugaauuucuaaaggg

SEQ ID NO: 133725 - RNA, 26 nt, Human
gggugagggcuggcgcacgggaggcc

SEQ ID NO: 133726 - RNA, 25 nt, Human
gccccuuccguccccaccccccucc

SEQ ID NO: 133727 - RNA, 20 nt, Human
ucaccuaguaugugagcagu

SEQ ID NO: 133728 - RNA, 22 nt, Human
gcuccucccacccuccuccagg

SEQ ID NO: 133729 - RNA, 21 nt, Human
agcaguuuuaccgcgaccucc

SEQ ID NO: 133730 - RNA, 27 nt, Human
ugucauugucauacaucauccagcuga

SEQ ID NO: 133731 - RNA, 24 nt, Human
ggcuggaugaagaaaugaccuuca

SEQ ID NO: 133732 - RNA, 23 nt, Human
uuccugagcagucccugcuuaug

SEQ ID NO: 133733 - RNA, 22 nt, Human
auccagucuguugaaggccuga

SEQ ID NO: 133734 - RNA, 21 nt, Human
gggguguuuuacaucuguaaa

SEQ ID NO: 133735 - RNA, 20 nt, Human
acuuugccagcacugccuuu

SEQ ID NO: 133736 - RNA, 27 nt, Human
cggaucgcugggcgcugugcagaggaa

SEQ ID NO: 133737 - RNA, 26 nt, Human
agguggugcugcagugguggcccugg

SEQ ID NO: 133738 - RNA, 26 nt, Human
ucccuguccccaccccagcgcagcag

SEQ ID NO: 133739 - RNA, 22 nt, Human
guugcccaggcuggagugcauu

SEQ ID NO: 133740 - RNA, 22 nt, Human
uugagccucaggauucuuguuc

SEQ ID NO: 133741 - RNA, 18 nt, Human
uucauuucugauuccuca

SEQ ID NO: 133742 - RNA, 22 nt, Human
agcccuaggaggggguggggca

SEQ ID NO: 133743 - RNA, 21 nt, Human
gccuccugaugcugugcucuu

SEQ ID NO: 133744 - RNA, 22 nt, Human
ucaggcugggggcaguggacag

SEQ ID NO: 133745 - RNA, 21 nt, Human
uauguaauauauuucuguggc

SEQ ID NO: 133746 - RNA, 27 nt, Human
ggacggggaguguuaccggggagcagc

SEQ ID NO: 133747 - RNA, 25 nt, Human
aaccuggcaggcggagguugcagug

SEQ ID NO: 133748 - RNA, 26 nt, Human
aggagggagagagguggacaggcaga

SEQ ID NO: 133749 - RNA, 22 nt, Human
gcugugaauauugccuggugau

SEQ ID NO: 133750 - RNA, 20 nt, Human
aaaaaauuaugugccaguga

SEQ ID NO: 133751 - RNA, 27 nt, Human
cagggagaacgcggggaccccagaaag

SEQ ID NO: 133752 - RNA, 26 nt, Human
cacccaggcuugaggcagcggcggga

SEQ ID NO: 133753 - RNA, 21 nt, Human
cagaucucaagaucucaaauu

SEQ ID NO: 133754 - RNA, 23 nt, Human
cagcaaauauuuucuuaaacuca

SEQ ID NO: 133755 - RNA, 23 nt, Human
aacagugguggcugggcucacag

SEQ ID NO: 133756 - RNA, 20 nt, Human
gguuucauagaguccucucc

SEQ ID NO: 133757 - RNA, 27 nt, Human
cugaguauugggaauccaaauugaauu

SEQ ID NO: 133758 - RNA, 20 nt, Human
ucucagauucuuaucuggca

SEQ ID NO: 133759 - RNA, 23 nt, Human
gcacccuggcagcagaccccaaa

SEQ ID NO: 133760 - RNA, 27 nt, Human
gugugucuguugaucuguguuuucauu

SEQ ID NO: 133761 - RNA, 25 nt, Human
ccacuuccuccuguuggacugccug

SEQ ID NO: 133762 - RNA, 26 nt, Human
aacacaaagcaucaguauuuauagca

SEQ ID NO: 133763 - RNA, 23 nt, Human
cccagcaccuggacaucucuucc

SEQ ID NO: 133764 - RNA, 21 nt, Human
uccuuuucacaccuuauuuca

SEQ ID NO: 133765 - RNA, 22 nt, Human
cccuaguaguugggauuacagg

SEQ ID NO: 133766 - RNA, 21 nt, Human
augagguuuauucuaucuguu

SEQ ID NO: 133767 - RNA, 25 nt, Human
ggugaucucugaggagauggaucgg

SEQ ID NO: 133768 - RNA, 23 nt, Human
uguuuuaaacauugaaaaguugu

SEQ ID NO: 133769 - RNA, 27 nt, Human
cucuuuuguaaauuacaguuauuucag

SEQ ID NO: 133770 - RNA, 25 nt, Human
gcccccagcccuccaguaccuucug

SEQ ID NO: 133771 - RNA, 22 nt, Human
cucaggagcugggggugcagug

SEQ ID NO: 133772 - RNA, 25 nt, Human
cacuccucaguguuuguggagucga

SEQ ID NO: 133773 - RNA, 23 nt, Human
gacauuucuucccuuccuuuuuc

SEQ ID NO: 133774 - RNA, 26 nt, Human
cagccaggcugggcagagcacuccgg

SEQ ID NO: 133775 - RNA, 20 nt, Human
agcucccuacagcuugggcc

SEQ ID NO: 133776 - RNA, 21 nt, Human
guuucuucucucauauauucc

SEQ ID NO: 133777 - RNA, 20 nt, Human
cuuccugaauucuuuaaaua

SEQ ID NO: 133778 - RNA, 19 nt, Human
uugcugagcaaacauguug

SEQ ID NO: 133779 - RNA, 24 nt, Human
ccgggagggggcgcggggcacggu

SEQ ID NO: 133780 - RNA, 23 nt, Human
ucugcuaaauuuaauaaaaacuu

SEQ ID NO: 133781 - RNA, 22 nt, Human
cuuuccagccgaaaacaggaga

SEQ ID NO: 133782 - RNA, 22 nt, Human
uucuuuacuaaggauacuauuc

SEQ ID NO: 133783 - RNA, 21 nt, Human
cugcuucuguuuauaugugca

SEQ ID NO: 133784 - RNA, 29 nt, Human
uugagaaugaaguugucauucagggcccc

SEQ ID NO: 133785 - RNA, 23 nt, Human
cccagcugagaggagaggcgccc

SEQ ID NO: 133786 - RNA, 30 nt, Human
cuaccuugaguaguuggagcacuugauaca

SEQ ID NO: 133787 - RNA, 26 nt, Human
ggggccuacggaggcgcaggagcggu

SEQ ID NO: 133788 - RNA, 22 nt, Human
ugagccaagaggaacuugaccc

SEQ ID NO: 133789 - RNA, 22 nt, Human
uugucauaaaguuuuaggaaag

SEQ ID NO: 133790 - RNA, 22 nt, Human
ggcucuugggcuggaguaccgu

SEQ ID NO: 133791 - RNA, 24 nt, Human
cugucucuaugguuuuaucuauuc

SEQ ID NO: 133792 - RNA, 22 nt, Human
agguucugggguuaagaaauaa

SEQ ID NO: 133793 - RNA, 27 nt, Human
cucugcccacuuccaccagagacacau

SEQ ID NO: 133794 - RNA, 24 nt, Human
uuuccccucaacaauuuugaagcu

SEQ ID NO: 133795 - RNA, 22 nt, Human
cuccugcugaccuucugcggcu

SEQ ID NO: 133796 - RNA, 23 nt, Human
cacuccgcccagucugggacucc

SEQ ID NO: 133797 - RNA, 19 nt, Human
cgucacugcacuccagcuu

SEQ ID NO: 133798 - RNA, 20 nt, Human
cugccacugcucuugccucu

SEQ ID NO: 133799 - RNA, 22 nt, Human
cacucugcucccccucuguaag

SEQ ID NO: 133800 - RNA, 21 nt, Human
aaacaccuuucccuuugcccu

SEQ ID NO: 133801 - RNA, 19 nt, Human
ucuuuagcccacaagucca

SEQ ID NO: 133802 - RNA, 22 nt, Human
uuucucucucccccuuugacag

SEQ ID NO: 133803 - RNA, 26 nt, Human
ccagccugggcgacaggcucaaaaaa

SEQ ID NO: 133804 - RNA, 18 nt, Human
ugaacacuucauucuucu

SEQ ID NO: 133805 - RNA, 23 nt, Human
ucaagcuuuggaaguccaaaaag

SEQ ID NO: 133806 - RNA, 27 nt, Human
cacagccgugcucgcccacaaacugau

SEQ ID NO: 133807 - RNA, 26 nt, Human
uggcgggggaggggcgccugggggug

SEQ ID NO: 133808 - RNA, 25 nt, Human
cacuaaggguggagaguugggggcc

SEQ ID NO: 133809 - RNA, 27 nt, Human
ccuuccucuccuuccuuguuacccaug

SEQ ID NO: 133810 - RNA, 27 nt, Human
caucugucacgugguucaccaucauca

SEQ ID NO: 133811 - RNA, 22 nt, Human
ucacuagccucagagcacucuc

SEQ ID NO: 133812 - RNA, 19 nt, Human
auuaguuuuaguuuuuugu

SEQ ID NO: 133813 - RNA, 20 nt, Human
ugucuucccugggcugccac

SEQ ID NO: 133814 - RNA, 23 nt, Human
gccccucccugccagcaccccca

SEQ ID NO: 133815 - RNA, 25 nt, Human
uuuguugacuucugccugugggucu

SEQ ID NO: 133816 - RNA, 23 nt, Human
ccuauuccauucccuccugcugc

SEQ ID NO: 133817 - RNA, 27 nt, Human
uucagagaguuaggaaggaaaaaccaa

SEQ ID NO: 133818 - RNA, 22 nt, Human
gcauuaugcaaaagcacaaaga

SEQ ID NO: 133819 - RNA, 19 nt, Human
ccuuugcucacauguuucc

SEQ ID NO: 133820 - RNA, 21 nt, Human
cuuggaguauuucacacugag

SEQ ID NO: 133821 - RNA, 21 nt, Human
gcuucccagcuggguacucug

SEQ ID NO: 133822 - RNA, 21 nt, Human
uuugauaaaauaaaugagcua

SEQ ID NO: 133823 - RNA, 26 nt, Human
acccucugccaccagagaccguccuc

SEQ ID NO: 133824 - RNA, 26 nt, Human
gggaggcaguuccuggcuaacgaaga

SEQ ID NO: 133825 - RNA, 18 nt, Human
ucugaacuccuauuuagg

SEQ ID NO: 133826 - RNA, 21 nt, Human
gagaagcaccacauccuuuca

SEQ ID NO: 133827 - RNA, 20 nt, Human
auuacagaauauauuuugga

SEQ ID NO: 133828 - RNA, 24 nt, Human
gggccggcccugccuccacguggc

SEQ ID NO: 133829 - RNA, 27 nt, Human
uaggguacucaauuuuauguuuccuuu

SEQ ID NO: 133830 - RNA, 22 nt, Human
uuuguucugcuuuaucuuuuca

SEQ ID NO: 133831 - RNA, 27 nt, Human
gggccuggggcucaaggagcuguaggu

SEQ ID NO: 133832 - RNA, 21 nt, Human
acgguucccaaccccaagggg

SEQ ID NO: 133833 - RNA, 27 nt, Human
cacacacacccuuccccacucccguga

SEQ ID NO: 133834 - RNA, 23 nt, Human
ucucucuccccagaaaaggcuca

SEQ ID NO: 133835 - RNA, 23 nt, Human
uuaguaggaagaaagggugcuua

SEQ ID NO: 133836 - RNA, 20 nt, Human
uaugggaccugugcccagcc

SEQ ID NO: 133837 - RNA, 22 nt, Human
guggcucucaacuggaauuggu

SEQ ID NO: 133838 - RNA, 20 nt, Human
accguuagagaugacuuuaa

SEQ ID NO: 133839 - RNA, 27 nt, Human
cccuccagcaaaggagucugaggcuga

SEQ ID NO: 133840 - RNA, 19 nt, Human
aaacaacagguuugcauuc

SEQ ID NO: 133841 - RNA, 18 nt, Human
cuucuuguugccuagcca

SEQ ID NO: 133842 - RNA, 22 nt, Human
cagaguguuagcuuagagcuca

SEQ ID NO: 133843 - RNA, 22 nt, Human
caggaaagcaccuguccuggcu

SEQ ID NO: 133844 - RNA, 22 nt, Human
ugcagccggcugagauggcgcc

SEQ ID NO: 133845 - RNA, 24 nt, Human
agaugcuuguauuuuacuuuucca

SEQ ID NO: 133846 - RNA, 21 nt, Human
gucuuaaagcccucugggcuc

SEQ ID NO: 133847 - RNA, 22 nt, Human
uaccagagcgguuuugccucag

SEQ ID NO: 133848 - RNA, 22 nt, Human
uccuccaggaagccuuccccua

SEQ ID NO: 133849 - RNA, 19 nt, Human
ucuccucucugagacugcu

SEQ ID NO: 133850 - RNA, 23 nt, Human
gccucggccucucugucaugcug

SEQ ID NO: 133851 - RNA, 25 nt, Human
uuccuuuggcuggcagcucuuccca

SEQ ID NO: 133852 - RNA, 25 nt, Human
ggaaagggaauuaacuuuggucacg

SEQ ID NO: 133853 - RNA, 21 nt, Human
agacagugccaacacugaagg

SEQ ID NO: 133854 - RNA, 22 nt, Human
gguaggauuuucuucccaggga

SEQ ID NO: 133855 - RNA, 20 nt, Human
gacguacuugcaguuuauga

SEQ ID NO: 133856 - RNA, 22 nt, Human
acuagccugggcaacaugguga

SEQ ID NO: 133857 - RNA, 21 nt, Human
ucagcauguccaacaugguaa

SEQ ID NO: 133858 - RNA, 20 nt, Human
acugcaggaucuuccuucug

SEQ ID NO: 133859 - RNA, 24 nt, Human
aucauggucuacuccucuuuccgu

SEQ ID NO: 133860 - RNA, 27 nt, Human
aacucugcuccucuagggccgccgcca

SEQ ID NO: 133861 - RNA, 22 nt, Human
gacuguggccagaucaugugug

SEQ ID NO: 133862 - RNA, 22 nt, Human
acaaggacucugguuacccuug

SEQ ID NO: 133863 - RNA, 26 nt, Human
gagcccaggcgguugaggcugcagug

SEQ ID NO: 133864 - RNA, 26 nt, Human
aaaugauuuguagaaacuugguuuuc

SEQ ID NO: 133865 - RNA, 26 nt, Human
uagggaggaggaggcgagaagauggc

SEQ ID NO: 133866 - RNA, 22 nt, Human
aacuggaggcagggaacauggg

SEQ ID NO: 133867 - RNA, 20 nt, Human
caaauuuuaacaaaaggaca

SEQ ID NO: 133868 - RNA, 26 nt, Human
acauuccguccuguuuugagaggagg

SEQ ID NO: 133869 - RNA, 24 nt, Human
uuugcuuucacagucucucuuccu

SEQ ID NO: 133870 - RNA, 17 nt, Human
gguagauagagugccuu

SEQ ID NO: 133871 - RNA, 26 nt, Human
ccugcuucuggcgccccacccacccc

SEQ ID NO: 133872 - RNA, 30 nt, Human
cucuccugagcgucuuucugcucuccuuau

SEQ ID NO: 133873 - RNA, 24 nt, Human
ucugggaggcuggagauccuuucu

SEQ ID NO: 133874 - RNA, 23 nt, Human
ucucgggaauuugaggccagccu

SEQ ID NO: 133875 - RNA, 20 nt, Human
ucccaggaucauccuuccuc

SEQ ID NO: 133876 - RNA, 25 nt, Human
gacaguuucuaccaguccugcuguc

SEQ ID NO: 133877 - RNA, 21 nt, Human
uucccaagcuggagugcagug

SEQ ID NO: 133878 - RNA, 21 nt, Human
aaucccagccggccaauggaa

SEQ ID NO: 133879 - RNA, 20 nt, Human
cuccucuuuaaaacaaaaca

SEQ ID NO: 133880 - RNA, 18 nt, Human
ccaaguaggauuacaagc

SEQ ID NO: 133881 - RNA, 26 nt, Human
gaaucagcucuuucaaacuugggguu

SEQ ID NO: 133882 - RNA, 26 nt, Human
aaugccacugccuucgcuucuugccu

SEQ ID NO: 133883 - RNA, 23 nt, Human
auccucucaccaugcguuagcaa

SEQ ID NO: 133884 - RNA, 21 nt, Human
ggcucuggcugcccagggccc

SEQ ID NO: 133885 - RNA, 27 nt, Human
ggaguucaguggagagguuagagccag

SEQ ID NO: 133886 - RNA, 26 nt, Human
uuccaaaaucagagucagacugcucc

SEQ ID NO: 133887 - RNA, 22 nt, Human
agagaaucuggcaauggaugaa

SEQ ID NO: 133888 - RNA, 23 nt, Human
gaagggagaauucugacgccaac

SEQ ID NO: 133889 - RNA, 22 nt, Human
aaagugucaccccucacuguga

SEQ ID NO: 133890 - RNA, 23 nt, Human
ucugcagcugccucaguuucccc

SEQ ID NO: 133891 - RNA, 22 nt, Human
ucucaacugauuuacucacuua

SEQ ID NO: 133892 - RNA, 21 nt, Human
uucaccugguccuuggcucac

SEQ ID NO: 133893 - RNA, 27 nt, Human
gcaaccucgacuucucagccuccuggg

SEQ ID NO: 133894 - RNA, 27 nt, Human
agcucacugcaaccuccgcaucccggg

SEQ ID NO: 133895 - RNA, 21 nt, Human
caauuuaaaaauaaaugagua

SEQ ID NO: 133896 - RNA, 21 nt, Human
ugugcucaggcuggugccagc

SEQ ID NO: 133897 - RNA, 22 nt, Human
cugcuccccuccuaccacuguc

SEQ ID NO: 133898 - RNA, 26 nt, Human
cuuagccugugaucugcccaugauga

SEQ ID NO: 133899 - RNA, 21 nt, Human
ggaggcagaggguugcaguga

SEQ ID NO: 133900 - RNA, 22 nt, Human
acugcaaccuuugccucccagg

SEQ ID NO: 133901 - RNA, 27 nt, Human
cuucauuccucuccaugcugcaaucac

SEQ ID NO: 133902 - RNA, 22 nt, Human
gaacuccuggucucuugcgguc

SEQ ID NO: 133903 - RNA, 24 nt, Human
ccugccugccuuccugacuucugu

SEQ ID NO: 133904 - RNA, 21 nt, Human
auaaacaucaaaaagugaaug

SEQ ID NO: 133905 - RNA, 23 nt, Human
accacacccagcuaauuuuuugu

SEQ ID NO: 133906 - RNA, 22 nt, Human
gaaagccgccucccccucccag

SEQ ID NO: 133907 - RNA, 25 nt, Human
ccaugauuaaccacuucagcugacu

SEQ ID NO: 133908 - RNA, 26 nt, Human
agacauucugccuaccuauuagcuuu

SEQ ID NO: 133909 - RNA, 29 nt, Human
cccccggccucagccaccagcacccccau

SEQ ID NO: 133910 - RNA, 27 nt, Human
gaccagccuggccaauacggcaaaacc

SEQ ID NO: 133911 - RNA, 22 nt, Human
gcguccucccugccuccuuccg

SEQ ID NO: 133912 - RNA, 22 nt, Human
ggaaagacuggcaagaaaagag

SEQ ID NO: 133913 - RNA, 21 nt, Human
aauauaguguuacuuccuucu

SEQ ID NO: 133914 - RNA, 20 nt, Human
ugaggaagagggagggaugg

SEQ ID NO: 133915 - RNA, 21 nt, Human
ugaaccaggcgccaggcucca

SEQ ID NO: 133916 - RNA, 22 nt, Human
ucugggaccuccuuagcccugu

SEQ ID NO: 133917 - RNA, 26 nt, Human
cugcaggcgugaauacacacaugcac

SEQ ID NO: 133918 - RNA, 22 nt, Human
gcucaugccuguaaucccagca

SEQ ID NO: 133919 - RNA, 25 nt, Human
aaaccagugagauacccaccugcuu

SEQ ID NO: 133920 - RNA, 21 nt, Human
ggccugaacaaagcacaucuu

SEQ ID NO: 133921 - RNA, 22 nt, Human
gcucacgccuguaaucccagca

SEQ ID NO: 133922 - RNA, 21 nt, Human
ggcaaagcugcacaacauaac

SEQ ID NO: 133923 - RNA, 22 nt, Human
cccuaguagcugggauuacagg

SEQ ID NO: 133924 - RNA, 22 nt, Human
cucacgagggguuucccgccuc

SEQ ID NO: 133925 - RNA, 23 nt, Human
ccugacacaggggacacugaacc

SEQ ID NO: 133926 - RNA, 27 nt, Human
cccaccccacccccuucagugcccacc

SEQ ID NO: 133927 - RNA, 24 nt, Human
acggagaguauauauagaucucua

SEQ ID NO: 133928 - RNA, 26 nt, Human
ucacgccccaaacagugcccgguggg

SEQ ID NO: 133929 - RNA, 16 nt, Human
acccugcuuacauuga

SEQ ID NO: 133930 - RNA, 23 nt, Human
cauuccccugcccaccuccuucc

SEQ ID NO: 133931 - RNA, 20 nt, Human
cggcgcagauccucuguggu

SEQ ID NO: 133932 - RNA, 31 nt, Human
ucacugaccaggccuuuccuggaggaaacac

SEQ ID NO: 133933 - RNA, 22 nt, Human
guaaaugcaggcccucuggcag

SEQ ID NO: 133934 - RNA, 21 nt, Human
uccaagugcuaggauuacagg

SEQ ID NO: 133935 - RNA, 23 nt, Human
ucucucagggccuuccccuuuca

SEQ ID NO: 133936 - RNA, 19 nt, Human
cuacuauccaaaaugugca

SEQ ID NO: 133937 - RNA, 24 nt, Human
ccccucggagcagcagccgccgcg

SEQ ID NO: 133938 - RNA, 25 nt, Human
gggaccggggaaagagggaggcuga

SEQ ID NO: 133939 - RNA, 21 nt, Human
gcucacugcagccuuguccuc

SEQ ID NO: 133940 - RNA, 21 nt, Human
uugggcugacaggugcugcug

SEQ ID NO: 133941 - RNA, 20 nt, Human
caggcuggagcauaguggca

SEQ ID NO: 133942 - RNA, 25 nt, Human
ugcgagccaggacuaggagauuccg

SEQ ID NO: 133943 - RNA, 20 nt, Human
uaugggacuggccucugcug

SEQ ID NO: 133944 - RNA, 23 nt, Human
auugcaaaauauguauuuuuaaa

SEQ ID NO: 133945 - RNA, 27 nt, Human
gucacuuauaauuaugcuaccuacuga

SEQ ID NO: 133946 - RNA, 27 nt, Human
uaaauugauuuuuauaaauacugcaaa

SEQ ID NO: 133947 - RNA, 23 nt, Human
aggcgaggaaacgagaccucuuu

SEQ ID NO: 133948 - RNA, 27 nt, Human
cagcuuugcuccccuauccucugcuuu

SEQ ID NO: 133949 - RNA, 22 nt, Human
gucaucuuggccaucuaaacau

SEQ ID NO: 133950 - RNA, 24 nt, Human
cugccgcccaaacuggagugcagu

SEQ ID NO: 133951 - RNA, 24 nt, Human
uucaaaccaguuucacauaaguua

SEQ ID NO: 133952 - RNA, 26 nt, Human
cugggaggggugcugccuuguagaug

SEQ ID NO: 133953 - RNA, 24 nt, Human
ucauguguaggcuguaauaugugu

SEQ ID NO: 133954 - RNA, 20 nt, Human
gagccucaggcagagcccgg

SEQ ID NO: 133955 - RNA, 24 nt, Human
ggcuaauuuaguuguauuuuuagu

SEQ ID NO: 133956 - RNA, 24 nt, Human
ggaucacggcagggccagagggug

SEQ ID NO: 133957 - RNA, 25 nt, Human
ucuaagauauaaguggaaugagccu

SEQ ID NO: 133958 - RNA, 22 nt, Human
aucagccuaggcaacaugguga

SEQ ID NO: 133959 - RNA, 25 nt, Human
aaacucaacagaauacuuuggcuug

SEQ ID NO: 133960 - RNA, 22 nt, Human
gggguuucuggcaccuaccuac

SEQ ID NO: 133961 - RNA, 19 nt, Human
agggccaccuccacaccca

SEQ ID NO: 133962 - RNA, 21 nt, Human
ccggcucaccaugcacugcca

SEQ ID NO: 133963 - RNA, 23 nt, Human
gcgugagccaccaacacccugcc

SEQ ID NO: 133964 - RNA, 21 nt, Human
uggccgccuguuuuuccagca

SEQ ID NO: 133965 - RNA, 21 nt, Human
ucaaagcauucuacaaugaac

SEQ ID NO: 133966 - RNA, 21 nt, Human
gguggugguuucuucagaauc

SEQ ID NO: 133967 - RNA, 20 nt, Human
uaucaugaaaaagacaagga

SEQ ID NO: 133968 - RNA, 22 nt, Human
ccugccuguguccuacagaugc

SEQ ID NO: 133969 - RNA, 20 nt, Human
cuccugacagggugaccuug

SEQ ID NO: 133970 - RNA, 21 nt, Human
ccaguuucagauuuacucuga

SEQ ID NO: 133971 - RNA, 26 nt, Human
uuuagcuucaguacugugacaguuau

SEQ ID NO: 133972 - RNA, 21 nt, Human
uccccaugugaggagaucugc

SEQ ID NO: 133973 - RNA, 22 nt, Human
cucugugagauaaaugcacauu

SEQ ID NO: 133974 - RNA, 22 nt, Human
cuagcuucuucagacucagccc

SEQ ID NO: 133975 - RNA, 21 nt, Human
ggagcacaguggugugaucac

SEQ ID NO: 133976 - RNA, 27 nt, Human
ucaggaggcugaggcaggaggaucaca

SEQ ID NO: 133977 - RNA, 21 nt, Human
ucaauauguggaagcaaccaa

SEQ ID NO: 133978 - RNA, 22 nt, Human
aagcuaaauacuuuccucucca

SEQ ID NO: 133979 - RNA, 27 nt, Human
cacugccuguggguuugcuggcuuaaa

SEQ ID NO: 133980 - RNA, 22 nt, Human
gugugguauuugauacagcuca

SEQ ID NO: 133981 - RNA, 26 nt, Human
cccuugccuaaauacaagggcuggag

SEQ ID NO: 133982 - RNA, 27 nt, Human
cuucccaacaaugugccccucaccccu

SEQ ID NO: 133983 - RNA, 25 nt, Human
cacacaccggcacuuucauacccug

SEQ ID NO: 133984 - RNA, 24 nt, Human
ccagccugcugagagcccccaccu

SEQ ID NO: 133985 - RNA, 28 nt, Human
gcuccuacauccagcuccucuaggggca

SEQ ID NO: 133986 - RNA, 22 nt, Human
cagcuccugggcauaagcugug

SEQ ID NO: 133987 - RNA, 24 nt, Human
gauuaaacugacuuuguuuuggcu

SEQ ID NO: 133988 - RNA, 32 nt, Human
cccucagauuauuuuuccucuggcuccuugga

SEQ ID NO: 133989 - RNA, 24 nt, Human
cugugauugugccacuguuuucca

SEQ ID NO: 133990 - RNA, 21 nt, Human
aauacgaccccacagacugcg

SEQ ID NO: 133991 - RNA, 24 nt, Human
cugucgccaggcuggagugcagug

SEQ ID NO: 133992 - RNA, 29 nt, Human
cugaguuuuaaagccaaacugacugagga

SEQ ID NO: 133993 - RNA, 22 nt, Human
gcggggauuccaggagucgugg

SEQ ID NO: 133994 - RNA, 19 nt, Human
aggaagagagugggcugca

SEQ ID NO: 133995 - RNA, 24 nt, Human
gcccaggcuggagugcaauggcag

SEQ ID NO: 133996 - RNA, 22 nt, Human
aaauaaucuuaaauacugcaaa

SEQ ID NO: 133997 - RNA, 21 nt, Human
auauggccacaccugggucuu

SEQ ID NO: 133998 - RNA, 22 nt, Human
gcuccugguccgcaguggcaga

SEQ ID NO: 133999 - RNA, 21 nt, Human
cccuccagggggcucugcucc

SEQ ID NO: 134000 - RNA, 23 nt, Human
gaccuggugaucugcccaccucg

SEQ ID NO: 134001 - RNA, 22 nt, Human
ggcagcugccucugcuccccug

SEQ ID NO: 134002 - RNA, 26 nt, Human
acucgagaggugggaggaacuccuug

SEQ ID NO: 134003 - RNA, 26 nt, Human
agagguggggugggaagagaggaggc

SEQ ID NO: 134004 - RNA, 22 nt, Human
cuccagccccagcugcccuggc

SEQ ID NO: 134005 - RNA, 22 nt, Human
agacuuuucuuuuuaaccuucu

SEQ ID NO: 134006 - RNA, 23 nt, Human
augagacaacacuauuuuuauuu

SEQ ID NO: 134007 - RNA, 24 nt, Human
uucacugucucaaccuuaucugca

SEQ ID NO: 134008 - RNA, 24 nt, Human
ucagaauucugaguacucugugaa

SEQ ID NO: 134009 - RNA, 22 nt, Human
cucgccagagaagacaagggca

SEQ ID NO: 134010 - RNA, 22 nt, Human
gucaaggcuggacagcuacugc

SEQ ID NO: 134011 - RNA, 22 nt, Human
acuguguuuuguggaucuuuaa

SEQ ID NO: 134012 - RNA, 23 nt, Human
gaugcaguucugaagaagauggu

SEQ ID NO: 134013 - RNA, 13 nt, Human
gcaguuacaugca

SEQ ID NO: 134014 - RNA, 24 nt, Human
gguaggagaaggcaucugagucuc

SEQ ID NO: 134015 - RNA, 26 nt, Human
gcccucucccccgccucuucugagcu

SEQ ID NO: 134016 - RNA, 21 nt, Human
uucaucgucucuccuucccuc

SEQ ID NO: 134017 - RNA, 21 nt, Human
ucuccucucucuugcucucag

SEQ ID NO: 134018 - RNA, 22 nt, Human
cccacuccaaagugugccaccu

SEQ ID NO: 134019 - RNA, 20 nt, Human
cccccaggcugaagugcagu

SEQ ID NO: 134020 - RNA, 24 nt, Human
uuaccacagacauacuaaccagca

SEQ ID NO: 134021 - RNA, 21 nt, Human
gccgaggcuggagcacaggga

SEQ ID NO: 134022 - RNA, 21 nt, Human
aguaggugggacaaguauaag

SEQ ID NO: 134023 - RNA, 26 nt, Human
uauagcaaccuauuuugacugcuuca

SEQ ID NO: 134024 - RNA, 25 nt, Human
caaccaaaaaagaaauaaauauucu

SEQ ID NO: 134025 - RNA, 26 nt, Human
gccaguucccugucagugacagggcu

SEQ ID NO: 134026 - RNA, 22 nt, Human
gguguggggccugggcugccag

SEQ ID NO: 134027 - RNA, 27 nt, Human
guggacaccugcccugcccugccaccu

SEQ ID NO: 134028 - RNA, 21 nt, Human
caggggcgccccgggagcagc

SEQ ID NO: 134029 - RNA, 24 nt, Human
cugcuucuguuuaaaaagccaaca

SEQ ID NO: 134030 - RNA, 21 nt, Human
auucuaagagccuuggacccg

SEQ ID NO: 134031 - RNA, 24 nt, Human
augccuggcuaguuuuuguauuuu

SEQ ID NO: 134032 - RNA, 26 nt, Human
ggcccuggaagagacgucgccucgcc

SEQ ID NO: 134033 - RNA, 29 nt, Human
uucauuaugauucacaccaaccugaagaa

SEQ ID NO: 134034 - RNA, 21 nt, Human
ccaugaguuuucagaugauuu

SEQ ID NO: 134035 - RNA, 21 nt, Human
gggacuguucuuugucagauu

SEQ ID NO: 134036 - RNA, 22 nt, Human
agcucuggugacauucucucca

SEQ ID NO: 134037 - RNA, 27 nt, Human
uggagaaagguguccuccaugcccuca

SEQ ID NO: 134038 - RNA, 18 nt, Human
cucugucucaaaagaaag

SEQ ID NO: 134039 - RNA, 22 nt, Human
ccacugcacaccagccugggug

SEQ ID NO: 134040 - RNA, 25 nt, Human
gccugugccagcaccacagccgguc

SEQ ID NO: 134041 - RNA, 24 nt, Human
gugacuccugauugccuccucaag

SEQ ID NO: 134042 - RNA, 18 nt, Human
gggggagcuagccuccua

SEQ ID NO: 134043 - RNA, 24 nt, Human
guugcccuuuacagaaucacucga

SEQ ID NO: 134044 - RNA, 22 nt, Human
auagaauacacagaauagugau

SEQ ID NO: 134045 - RNA, 27 nt, Human
gcaggagaauugcuugaacccaggaag

SEQ ID NO: 134046 - RNA, 20 nt, Human
aggaacggaagggagcccug

SEQ ID NO: 134047 - RNA, 27 nt, Human
gccacaucucaguuaucuaaacuagau

SEQ ID NO: 134048 - RNA, 23 nt, Human
agcuacucucuugccagcauuuu

SEQ ID NO: 134049 - RNA, 27 nt, Human
ugcugccauucugaggaacaucuccaa

SEQ ID NO: 134050 - RNA, 21 nt, Human
aaaugcacaggagcuugguag

SEQ ID NO: 134051 - RNA, 24 nt, Human
cucaugaacucaaucccugcccag

SEQ ID NO: 134052 - RNA, 26 nt, Human
gcgcacaccucccugccucgccccga

SEQ ID NO: 134053 - RNA, 21 nt, Human
cuucugcuugcuuuauuaacu

SEQ ID NO: 134054 - RNA, 20 nt, Human
caaaccagacauaugcuuag

SEQ ID NO: 134055 - RNA, 18 nt, Human
gguacuuggaagggcaaa

SEQ ID NO: 134056 - RNA, 25 nt, Human
agcagcuccuccuccucccucccaa

SEQ ID NO: 134057 - RNA, 21 nt, Human
gcccggccacacccaugcccu

SEQ ID NO: 134058 - RNA, 23 nt, Human
gcagaggauccaucacagacgga

SEQ ID NO: 134059 - RNA, 22 nt, Human
ccaauuucuguccacuuccuca

SEQ ID NO: 134060 - RNA, 24 nt, Human
gcucugaauggagaaacucucuag

SEQ ID NO: 134061 - RNA, 23 nt, Human
cugagcugccuccugucucucca

SEQ ID NO: 134062 - RNA, 18 nt, Human
gaucacuaaaugaaugga

SEQ ID NO: 134063 - RNA, 18 nt, Human
uucaguguuaacuccuuu

SEQ ID NO: 134064 - RNA, 28 nt, Human
gcuuuauuuggaaagcagugugcauauc

SEQ ID NO: 134065 - RNA, 22 nt, Human
acaacauggugaaaccccgucu

SEQ ID NO: 134066 - RNA, 22 nt, Human
ccaacauggcgaaaccaugucu

SEQ ID NO: 134067 - RNA, 22 nt, Human
ccccaacaacaacuuuucccuc

SEQ ID NO: 134068 - RNA, 21 nt, Human
uguguugacuuugcugccauc

SEQ ID NO: 134069 - RNA, 17 nt, Human
ucauuuuuccuuacaac

SEQ ID NO: 134070 - RNA, 18 nt, Human
caggcugaagugcaguga

SEQ ID NO: 134071 - RNA, 25 nt, Human
aacuagauaugauuaaaaauaagua

SEQ ID NO: 134072 - RNA, 21 nt, Human
caagaauuuuaauuuauucau

SEQ ID NO: 134073 - RNA, 18 nt, Human
agccaagagaaucaaaga

SEQ ID NO: 134074 - RNA, 22 nt, Human
ugaaacugaguugaauagagaa

SEQ ID NO: 134075 - RNA, 21 nt, Human
gauggauucuuccauccugcc

SEQ ID NO: 134076 - RNA, 32 nt, Human
ggaggagaagagaagagccaaccagaagagcu

SEQ ID NO: 134077 - RNA, 23 nt, Human
gcaccugcaucuucugaucaccu

SEQ ID NO: 134078 - RNA, 22 nt, Human
cugagauugcaccauugcacuc

SEQ ID NO: 134079 - RNA, 27 nt, Human
gaggaugagaggggcgagcuuuauuuc

SEQ ID NO: 134080 - RNA, 27 nt, Human
gucagaucucugugguuacaagaaaca

SEQ ID NO: 134081 - RNA, 24 nt, Human
gaauggcugggcagagcagagggg

SEQ ID NO: 134082 - RNA, 20 nt, Human
gacagcuucuacuucgugga

SEQ ID NO: 134083 - RNA, 26 nt, Human
cugcagcugcuuuccauuuuuauaua

SEQ ID NO: 134084 - RNA, 24 nt, Human
caccauggaucugguugugcauag

SEQ ID NO: 134085 - RNA, 20 nt, Human
accaaaacugcuccuccucc

SEQ ID NO: 134086 - RNA, 26 nt, Human
gucucgaacucaugaccucaagugau

SEQ ID NO: 134087 - RNA, 23 nt, Human
ccuccuuccuugggccugccuca

SEQ ID NO: 134088 - RNA, 23 nt, Human
ugcuuuggaaguaagaagguuga

SEQ ID NO: 134089 - RNA, 23 nt, Human
gagcauacaucuuaaaucuuuuc

SEQ ID NO: 134090 - RNA, 21 nt, Human
ggagagaaggagaaggauuag

SEQ ID NO: 134091 - RNA, 21 nt, Human
gccuuugagaaaugaaugaag

SEQ ID NO: 134092 - RNA, 25 nt, Human
uacugccugagcaaaccugaggccu

SEQ ID NO: 134093 - RNA, 24 nt, Human
cugagucuguguaguaaauuuuug

SEQ ID NO: 134094 - RNA, 26 nt, Human
uguacucugggcaagagcccaaaaug

SEQ ID NO: 134095 - RNA, 27 nt, Human
guucagccacacccagugguagcucca

SEQ ID NO: 134096 - RNA, 21 nt, Human
ugguagggagaguaagucagc

SEQ ID NO: 134097 - RNA, 22 nt, Human
cugucuuauucucuuuauuucu

SEQ ID NO: 134098 - RNA, 27 nt, Human
aacagcaucuuuaaaacuguguagcua

SEQ ID NO: 134099 - RNA, 22 nt, Human
gcaugagccaccgcacccagcu

SEQ ID NO: 134100 - RNA, 19 nt, Human
gcucaaagaagaaaaagaa

SEQ ID NO: 134101 - RNA, 17 nt, Human
ccuacuuccacuguaag

SEQ ID NO: 134102 - RNA, 21 nt, Human
accaaggcucagaaguuuuug

SEQ ID NO: 134103 - RNA, 24 nt, Human
acggccccucucuucccagcacuu

SEQ ID NO: 134104 - RNA, 24 nt, Human
cccaaagugcugggauuaugggcg

SEQ ID NO: 134105 - RNA, 21 nt, Human
uagacaccuaugcagucaugu

SEQ ID NO: 134106 - RNA, 20 nt, Human
acacaccuacugcuuccuca

SEQ ID NO: 134107 - RNA, 23 nt, Human
gugacgugguagucacuuguaag

SEQ ID NO: 134108 - RNA, 26 nt, Human
acucacuggcaucuuugcuaugggga

SEQ ID NO: 134109 - RNA, 22 nt, Human
ccacuacacuccagccugggcg

SEQ ID NO: 134110 - RNA, 23 nt, Human
ccaggaguuuaaggcugcaguga

SEQ ID NO: 134111 - RNA, 22 nt, Human
uugugccacuacacuccagccu

SEQ ID NO: 134112 - RNA, 21 nt, Human
aauacuuaauagcaaauaaau

SEQ ID NO: 134113 - RNA, 26 nt, Human
aucaaggcaaaucagcaagcccccaa

SEQ ID NO: 134114 - RNA, 26 nt, Human
acucaccucauccuuaccgcacauuu

SEQ ID NO: 134115 - RNA, 22 nt, Human
uggcaucagaaagugguggcgu

SEQ ID NO: 134116 - RNA, 18 nt, Human
uucaguuagccuucugua

SEQ ID NO: 134117 - RNA, 22 nt, Human
gccugcuguucgugacucagaa

SEQ ID NO: 134118 - RNA, 25 nt, Human
uuguucucuuuuucacugacacugu

SEQ ID NO: 134119 - RNA, 25 nt, Human
acccuaaacgaggagcugggccagg

SEQ ID NO: 134120 - RNA, 23 nt, Human
ggcgauguguagugccuuccaua

SEQ ID NO: 134121 - RNA, 27 nt, Human
ggucuugaacuccugaccucaacugau

SEQ ID NO: 134122 - RNA, 22 nt, Human
gcccuggcuggaguucaguggu

SEQ ID NO: 134123 - RNA, 27 nt, Human
cauuccucagcuucuucacaggcacuc

SEQ ID NO: 134124 - RNA, 23 nt, Human
ugaccaacauggugaaaacccca

SEQ ID NO: 134125 - RNA, 24 nt, Human
agccucccaaaucaagucucucca

SEQ ID NO: 134126 - RNA, 21 nt, Human
aaugaaguacucacacaugcc

SEQ ID NO: 134127 - RNA, 20 nt, Human
uuggggcaggaguagcugag

SEQ ID NO: 134128 - RNA, 18 nt, Human
cugccucugccugggguc

SEQ ID NO: 134129 - RNA, 27 nt, Human
uuccuuuguaaaaccugggcuggaagu

SEQ ID NO: 134130 - RNA, 23 nt, Human
agaaaucauggacucacaggguc

SEQ ID NO: 134131 - RNA, 27 nt, Human
uaguuuauuauaaaggugacugcaccc

SEQ ID NO: 134132 - RNA, 25 nt, Human
auggaugcagaaaaaucugggcuga

SEQ ID NO: 134133 - RNA, 18 nt, Human
gaucacauuucucacugc

SEQ ID NO: 134134 - RNA, 26 nt, Human
ucucuagccuuccuuuucugcugcuc

SEQ ID NO: 134135 - RNA, 26 nt, Human
uuucuuucuuucuuucuuuuuaagcu

SEQ ID NO: 134136 - RNA, 25 nt, Human
ucacacucucaccuaggugagcgca

SEQ ID NO: 134137 - RNA, 20 nt, Human
ggggugaggguaagggguag

SEQ ID NO: 134138 - RNA, 20 nt, Human
uuaaaaaaguaaaacaagaa

SEQ ID NO: 134139 - RNA, 20 nt, Human
gcuuuacaguuuaagccaca

SEQ ID NO: 134140 - RNA, 22 nt, Human
guccuguuuaguucuuaguggg

SEQ ID NO: 134141 - RNA, 20 nt, Human
cuuuucuguucaugcacaca

SEQ ID NO: 134142 - RNA, 26 nt, Human
ugggagaacacagacaggcagaggau

SEQ ID NO: 134143 - RNA, 23 nt, Human
gccuguaaucucagcuacucagg

SEQ ID NO: 134144 - RNA, 22 nt, Human
cacuaccacacccagcuaauuu

SEQ ID NO: 134145 - RNA, 22 nt, Human
cccacccacacacaguacccug

SEQ ID NO: 134146 - RNA, 22 nt, Human
gcccauggacucuucagucugg

SEQ ID NO: 134147 - RNA, 25 nt, Human
aacauugcugccacugugcuaaugg

SEQ ID NO: 134148 - RNA, 22 nt, Human
uccuucagagccucagccacua

SEQ ID NO: 134149 - RNA, 25 nt, Human
cgcaagaaacuugcacgacugcacc

SEQ ID NO: 134150 - RNA, 21 nt, Human
ucacguuucacaucucacuca

SEQ ID NO: 134151 - RNA, 23 nt, Human
ugguccccgagacacaggcacgg

SEQ ID NO: 134152 - RNA, 23 nt, Human
uggagcuugacuggggggugggg

SEQ ID NO: 134153 - RNA, 27 nt, Human
gucuguauauguugcacugaaaagguu

SEQ ID NO: 134154 - RNA, 18 nt, Human
cuugcagacuguggcgca

SEQ ID NO: 134155 - RNA, 21 nt, Human
cagggaggguauuuauugguc

SEQ ID NO: 134156 - RNA, 20 nt, Human
acaacuacuggaauauuguc

SEQ ID NO: 134157 - RNA, 26 nt, Human
gaagagagagguucacuguaguccug

SEQ ID NO: 134158 - RNA, 21 nt, Human
ugcagaauuaugcacugacau

SEQ ID NO: 134159 - RNA, 25 nt, Human
ggguuauggcggcggcggcagugag

SEQ ID NO: 134160 - RNA, 23 nt, Human
gaaggggagaagcauagagggcc

SEQ ID NO: 134161 - RNA, 21 nt, Human
aauauagcuuaaaacacuucu

SEQ ID NO: 134162 - RNA, 22 nt, Human
ccugccuggcccagccugcacc

SEQ ID NO: 134163 - RNA, 26 nt, Human
gcuguaauuuugguugcuuuugcccu

SEQ ID NO: 134164 - RNA, 22 nt, Human
uccccacccuccaacacgugcu

SEQ ID NO: 134165 - RNA, 21 nt, Human
cuccagcccccggcucccggc

SEQ ID NO: 134166 - RNA, 24 nt, Human
gaaauaaacugguucacuaguaga

SEQ ID NO: 134167 - RNA, 22 nt, Human
gcucucggugucucgggccacc

SEQ ID NO: 134168 - RNA, 23 nt, Human
ggaggugggggauugagggaggg

SEQ ID NO: 134169 - RNA, 23 nt, Human
cuucauacugcugcucuguugcc

SEQ ID NO: 134170 - RNA, 21 nt, Human
cugccugaguuuccagccugc

SEQ ID NO: 134171 - RNA, 27 nt, Human
ggguuccgaggcccaagcccuuggcag

SEQ ID NO: 134172 - RNA, 19 nt, Human
uuugcacagggagugcagg

SEQ ID NO: 134173 - RNA, 23 nt, Human
ccuucauugccacacuugguggg

SEQ ID NO: 134174 - RNA, 20 nt, Human
aguaggcaagcucugcugcg

SEQ ID NO: 134175 - RNA, 22 nt, Human
uguggcacauaaggaucugcag

SEQ ID NO: 134176 - RNA, 20 nt, Human
ugaccuccacccaccugccc

SEQ ID NO: 134177 - RNA, 27 nt, Human
cugggcuguugaugcaggucaggugga

SEQ ID NO: 134178 - RNA, 27 nt, Human
caccgcacuccagccugggcaacagag

SEQ ID NO: 134179 - RNA, 27 nt, Human
cacugcacuccagccuggguaacagag

SEQ ID NO: 134180 - RNA, 27 nt, Human
ccauuucucccuguuauuuuaguugcc

SEQ ID NO: 134181 - RNA, 22 nt, Human
uucuaguuuugacauuuuauga

SEQ ID NO: 134182 - RNA, 23 nt, Human
uacugcuacuacacuuugcuccu

SEQ ID NO: 134183 - RNA, 26 nt, Human
ccuggcccagcuacuccuuuaccugu

SEQ ID NO: 134184 - RNA, 27 nt, Human
cgcucugcccucccuggccucacgccc

SEQ ID NO: 134185 - RNA, 20 nt, Human
ggcuucauccaucccacccg

SEQ ID NO: 134186 - RNA, 26 nt, Human
guggcccugauccaggaaaaugugag

SEQ ID NO: 134187 - RNA, 21 nt, Human
gccccgcggcggccugggcag

SEQ ID NO: 134188 - RNA, 18 nt, Human
agugcgucugaggggaca

SEQ ID NO: 134189 - RNA, 28 nt, Human
gcugccccucucugggccucagaggccu

SEQ ID NO: 134190 - RNA, 21 nt, Human
cccagcuauggccccaggguu

SEQ ID NO: 134191 - RNA, 26 nt, Human
ggagcagcacuagcuccugcccacac

SEQ ID NO: 134192 - RNA, 21 nt, Human
gucugagugguggucuuuggg

SEQ ID NO: 134193 - RNA, 26 nt, Human
acacagaccacauagcacacaugugc

SEQ ID NO: 134194 - RNA, 25 nt, Human
agaacagaucucacaagaaccuaga

SEQ ID NO: 134195 - RNA, 22 nt, Human
ggggcucaaaggcgcucacuua

SEQ ID NO: 134196 - RNA, 26 nt, Human
ccaguucuuccugcaaccacucugug

SEQ ID NO: 134197 - RNA, 20 nt, Human
acuaguaauaauguaauacu

SEQ ID NO: 134198 - RNA, 21 nt, Human
agcggauggcaacuggaacau

SEQ ID NO: 134199 - RNA, 22 nt, Human
guuugguuuugucaucuguaaa

SEQ ID NO: 134200 - RNA, 27 nt, Human
cucaauaaagucaccuauucauucaua

SEQ ID NO: 134201 - RNA, 21 nt, Human
caggggguggagguugcagug

SEQ ID NO: 134202 - RNA, 27 nt, Human
aacacccacgcugguuucugugcagug

SEQ ID NO: 134203 - RNA, 26 nt, Human
cuggaagcauauuccccaagagcacu

SEQ ID NO: 134204 - RNA, 24 nt, Human
aaagagaaaucuggaagugugaga

SEQ ID NO: 134205 - RNA, 27 nt, Human
gggacccgcugggggcuggcagagggc

SEQ ID NO: 134206 - RNA, 23 nt, Human
ccuuccuuccuucuccugggacu

SEQ ID NO: 134207 - RNA, 20 nt, Human
aggagaaaguuucuuaugga

SEQ ID NO: 134208 - RNA, 21 nt, Human
gcucacagccugcucccagug

SEQ ID NO: 134209 - RNA, 23 nt, Human
gcagugcugugucugcugccucc

SEQ ID NO: 134210 - RNA, 29 nt, Human
guccagccuaggcaacagagugagacuuu

SEQ ID NO: 134211 - RNA, 23 nt, Human
aucagugagcucaggagagagcu

SEQ ID NO: 134212 - RNA, 20 nt, Human
guagacaccucuccacuccu

SEQ ID NO: 134213 - RNA, 20 nt, Human
uuaauaaggagucagaccua

SEQ ID NO: 134214 - RNA, 25 nt, Human
aaagccaucuauucuucugcagccu

SEQ ID NO: 134215 - RNA, 26 nt, Human
ucuccaccagggucgcuccaucaccc

SEQ ID NO: 134216 - RNA, 23 nt, Human
ucuugcuuguggcgccuuccuca

SEQ ID NO: 134217 - RNA, 22 nt, Human
cauagagcuggucucacugugg

SEQ ID NO: 134218 - RNA, 27 nt, Human
gcugccucugccuucugaugcuggacu

SEQ ID NO: 134219 - RNA, 26 nt, Human
uacuuuguuauuuuuccccaaaaaga

SEQ ID NO: 134220 - RNA, 29 nt, Human
cgaggaaaaggaaagagucucagagugga

SEQ ID NO: 134221 - RNA, 23 nt, Human
ccccaaaauccaaaacuucucuu

SEQ ID NO: 134222 - RNA, 21 nt, Human
cagugugauugauugcuuuau

SEQ ID NO: 134223 - RNA, 22 nt, Human
gucuguucucuccucuguccca

SEQ ID NO: 134224 - RNA, 27 nt, Human
ccugggcuggguggccccugucucggg

SEQ ID NO: 134225 - RNA, 30 nt, Human
ccgcaggaacgcgccgaggucucccucacc

SEQ ID NO: 134226 - RNA, 19 nt, Human
cugccucuuuccuguuguu

SEQ ID NO: 134227 - RNA, 23 nt, Human
ggagcaagaaggaaggaggcaga

SEQ ID NO: 134228 - RNA, 27 nt, Human
caugguuaaaauagcggccugugccca

SEQ ID NO: 134229 - RNA, 27 nt, Human
agggucuggugccaauccuguaggcac

SEQ ID NO: 134230 - RNA, 20 nt, Human
caggaguuugagaccagugu

SEQ ID NO: 134231 - RNA, 20 nt, Human
aggugaaugacuaaagcuuu

SEQ ID NO: 134232 - RNA, 24 nt, Human
caugaggugcagaggcccacccag

SEQ ID NO: 134233 - RNA, 25 nt, Human
gacucuccacuucugcucaaugcug

SEQ ID NO: 134234 - RNA, 23 nt, Human
gucccugcuaugcagaugucuaa

SEQ ID NO: 134235 - RNA, 26 nt, Human
ugggagaagagaaggcuaaaggagcu

SEQ ID NO: 134236 - RNA, 21 nt, Human
uccuuaaagaaacaaagucca

SEQ ID NO: 134237 - RNA, 20 nt, Human
acaguauuuuggggagcaaa

SEQ ID NO: 134238 - RNA, 25 nt, Human
uacuuucugaauaacggaagggauc

SEQ ID NO: 134239 - RNA, 24 nt, Human
agugagccugcggggaggcugguc

SEQ ID NO: 134240 - RNA, 23 nt, Human
gugccuggcccuaugagggcggc

SEQ ID NO: 134241 - RNA, 25 nt, Human
ucuacuuccagcuguguucugugga

SEQ ID NO: 134242 - RNA, 21 nt, Human
cuaaagccucucgggggcagg

SEQ ID NO: 134243 - RNA, 24 nt, Human
auuucugagcauuuaauauggaug

SEQ ID NO: 134244 - RNA, 27 nt, Human
cuucugagugggcuucucugggagcuc

SEQ ID NO: 134245 - RNA, 22 nt, Human
aucugccaggcaguuuuuucuu

SEQ ID NO: 134246 - RNA, 31 nt, Human
ggugugaaugaggcaggaugaacuggacagg

SEQ ID NO: 134247 - RNA, 22 nt, Human
gcugcugcuucccuugugcacu

SEQ ID NO: 134248 - RNA, 21 nt, Human
uucauuucuccuguccccucc

SEQ ID NO: 134249 - RNA, 24 nt, Human
ccuuauccuuucucccucuguaaa

SEQ ID NO: 134250 - RNA, 26 nt, Human
ccuccaggcgguugcggcgggcgcgg

SEQ ID NO: 134251 - RNA, 25 nt, Human
ggagaguucauggagagagcaugug

SEQ ID NO: 134252 - RNA, 28 nt, Human
ggggagagagaggaagcgacugagcccu

SEQ ID NO: 134253 - RNA, 26 nt, Human
caggcagcaggccucaggcccagacu

SEQ ID NO: 134254 - RNA, 21 nt, Human
uucauuccuuucucuuccuca

SEQ ID NO: 134255 - RNA, 19 nt, Human
aggcugaggcagaauugcu

SEQ ID NO: 134256 - RNA, 26 nt, Human
ccugccugcccucccugcccagcugu

SEQ ID NO: 134257 - RNA, 28 nt, Human
agaggaggaaagcaggcauuugauuuug

SEQ ID NO: 134258 - RNA, 22 nt, Human
aacucagaucaaaaaugggcag

SEQ ID NO: 134259 - RNA, 27 nt, Human
ccauuguacuccagccugugugacaga

SEQ ID NO: 134260 - RNA, 20 nt, Human
uaauucuagcugagugcaau

SEQ ID NO: 134261 - RNA, 22 nt, Human
ugugcaggcuguagugcagugg

SEQ ID NO: 134262 - RNA, 22 nt, Human
uggcucacaccuguaaucucag

SEQ ID NO: 134263 - RNA, 22 nt, Human
uggcucacacuuguaaucccag

SEQ ID NO: 134264 - RNA, 18 nt, Human
gaacacaucucucuuuua

SEQ ID NO: 134265 - RNA, 22 nt, Human
cgugcugucuguggaguguguc

SEQ ID NO: 134266 - RNA, 27 nt, Human
uucacaguucagaccggucuucaaagg

SEQ ID NO: 134267 - RNA, 23 nt, Human
ugagcuuuagaaagaaacuggaa

SEQ ID NO: 134268 - RNA, 27 nt, Human
cuaggagguggcuccagcagaggaagu

SEQ ID NO: 134269 - RNA, 21 nt, Human
cgcuccucuccagcccugcag

SEQ ID NO: 134270 - RNA, 22 nt, Human
gucuauaaucccagcacuuugg

SEQ ID NO: 134271 - RNA, 25 nt, Human
agcaauucuguggcuucagccuccg

SEQ ID NO: 134272 - RNA, 25 nt, Human
ggaggugaggagcagagcaggcaau

SEQ ID NO: 134273 - RNA, 21 nt, Human
uuauguggaaacaacaacaaa

SEQ ID NO: 134274 - RNA, 25 nt, Human
cccacugcugcccgacacugcccuu

SEQ ID NO: 134275 - RNA, 21 nt, Human
aggagauugaggcugcaguga

SEQ ID NO: 134276 - RNA, 20 nt, Human
gaccccaucaaaggucucag

SEQ ID NO: 134277 - RNA, 28 nt, Human
ccacuggcacuccagccugggcaacaga

SEQ ID NO: 134278 - RNA, 20 nt, Human
uguauuuaguaaaaauaaau

SEQ ID NO: 134279 - RNA, 25 nt, Human
ccuguucuccccucgucgguggcua

SEQ ID NO: 134280 - RNA, 22 nt, Human
cacccaggcugcagugcaaugg

SEQ ID NO: 134281 - RNA, 21 nt, Human
guccaggcaggguguagggga

SEQ ID NO: 134282 - RNA, 27 nt, Human
agaccuccccagccccuagcccaggag

SEQ ID NO: 134283 - RNA, 23 nt, Human
gcuagcccaggcuggggaucucg

SEQ ID NO: 134284 - RNA, 23 nt, Human
aggcugcuucccagaggagcagc

SEQ ID NO: 134285 - RNA, 22 nt, Human
uugcucuuaaucacagggcaag

SEQ ID NO: 134286 - RNA, 22 nt, Human
cacugucagucaagcuugucca

SEQ ID NO: 134287 - RNA, 24 nt, Human
uggggugggggagcaggagaaagc

SEQ ID NO: 134288 - RNA, 19 nt, Human
ccuucauucccauggucug

SEQ ID NO: 134289 - RNA, 24 nt, Human
cugucgcccuggcuggagugcaau

SEQ ID NO: 134290 - RNA, 22 nt, Human
gagcacccaggcggaucugcaa

SEQ ID NO: 134291 - RNA, 29 nt, Human
ccagaugacacuuaagaccuacuugugau

SEQ ID NO: 134292 - RNA, 21 nt, Human
cuugagaccuuuucacugugg

SEQ ID NO: 134293 - RNA, 26 nt, Human
agcuuugaaagcagucacuguggugu

SEQ ID NO: 134294 - RNA, 25 nt, Human
ugugcggcugccccuucccugccuc

SEQ ID NO: 134295 - RNA, 22 nt, Human
gggguccccagauucugcucua

SEQ ID NO: 134296 - RNA, 23 nt, Human
cagcccugaccuggaaugucucc

SEQ ID NO: 134297 - RNA, 26 nt, Human
aucuguguauacaccacacguuacaa

SEQ ID NO: 134298 - RNA, 25 nt, Human
cuccugccucauccccuucccacca

SEQ ID NO: 134299 - RNA, 27 nt, Human
caaaacaaaauaggugaggggauagcg

SEQ ID NO: 134300 - RNA, 21 nt, Human
uccagagacaaagguggggag

SEQ ID NO: 134301 - RNA, 23 nt, Human
ccaggagacggugguugcaguga

SEQ ID NO: 134302 - RNA, 24 nt, Human
cacaucccacugagcaugggacca

SEQ ID NO: 134303 - RNA, 20 nt, Human
acagcuucuauauuuuguaa

SEQ ID NO: 134304 - RNA, 26 nt, Human
gagugugugggggucugggaggcagg

SEQ ID NO: 134305 - RNA, 21 nt, Human
uuuucauaucaaaagaucaug

SEQ ID NO: 134306 - RNA, 22 nt, Human
uaaggcugucuugguguauaca

SEQ ID NO: 134307 - RNA, 25 nt, Human
cuaaugccaccacuaccccugccau

SEQ ID NO: 134308 - RNA, 21 nt, Human
gcgcccccacacccgggcccg

SEQ ID NO: 134309 - RNA, 17 nt, Human
agaugaucuugucugga

SEQ ID NO: 134310 - RNA, 21 nt, Human
acgugaaguugucgcugccuu

SEQ ID NO: 134311 - RNA, 26 nt, Human
aagcauuuugcuaaggagaagcuaau

SEQ ID NO: 134312 - RNA, 22 nt, Human
cacgaggucaggagauugagac

SEQ ID NO: 134313 - RNA, 20 nt, Human
cacacaaaagcagaccugcg

SEQ ID NO: 134314 - RNA, 21 nt, Human
gugucuccuuuuauacuugaa

SEQ ID NO: 134315 - RNA, 23 nt, Human
acuccugccauucuucuggugcu

SEQ ID NO: 134316 - RNA, 21 nt, Human
aaagcauuugucucccaccuc

SEQ ID NO: 134317 - RNA, 32 nt, Human
agagcggagcacaggagcaggaagccgccuac

SEQ ID NO: 134318 - RNA, 23 nt, Human
ggcugacacaccuccuguccacu

SEQ ID NO: 134319 - RNA, 26 nt, Human
ucacccuguugcccaggcuggagugc

SEQ ID NO: 134320 - RNA, 19 nt, Human
ccuguccccgacugugcca

SEQ ID NO: 134321 - RNA, 28 nt, Human
uuugagucugugucugugagagagccag

SEQ ID NO: 134322 - RNA, 27 nt, Human
uguuuuuaaaaggcucuuccauggcag

SEQ ID NO: 134323 - RNA, 21 nt, Human
ucacgccugcuuccucccucc

SEQ ID NO: 134324 - RNA, 21 nt, Human
aggaacugcgguguugggaga

SEQ ID NO: 134325 - RNA, 23 nt, Human
caccauggucagggagguggcag

SEQ ID NO: 134326 - RNA, 21 nt, Human
uguuauccuuccaucaugacu

SEQ ID NO: 134327 - RNA, 20 nt, Human
cuuuuuucauuucuuccuca

SEQ ID NO: 134328 - RNA, 26 nt, Human
gcuucugcuguuuuuguagguuuauc

SEQ ID NO: 134329 - RNA, 27 nt, Human
ucugcagcuguagauucucacugugaa

SEQ ID NO: 134330 - RNA, 22 nt, Human
augcagaucugcguggcuggug

SEQ ID NO: 134331 - RNA, 22 nt, Human
caugagguggagguugcgguga

SEQ ID NO: 134332 - RNA, 21 nt, Human
uggagagagucccggacaugc

SEQ ID NO: 134333 - RNA, 22 nt, Human
gagaaggcucccuccccauggg

SEQ ID NO: 134334 - RNA, 22 nt, Human
agccugcuccuucccuugcuac

SEQ ID NO: 134335 - RNA, 22 nt, Human
ugcacuuccuguucauguacga

SEQ ID NO: 134336 - RNA, 19 nt, Human
aauuucuuuucuuccuguc

SEQ ID NO: 134337 - RNA, 26 nt, Human
aggcagcagauuguugauggcuuuaa

SEQ ID NO: 134338 - RNA, 22 nt, Human
ggcucacugcaagcucugcguc

SEQ ID NO: 134339 - RNA, 27 nt, Human
ggguauuucaugucucagggaguaggu

SEQ ID NO: 134340 - RNA, 23 nt, Human
cacugcacuugccaccugaguca

SEQ ID NO: 134341 - RNA, 27 nt, Human
ccuguucucucugugcucuugcauucu

SEQ ID NO: 134342 - RNA, 22 nt, Human
gcaagcaagggugaccuccagu

SEQ ID NO: 134343 - RNA, 21 nt, Human
uuucacucuccucuagcuauc

SEQ ID NO: 134344 - RNA, 22 nt, Human
ucaggcaaagugcugcuggaag

SEQ ID NO: 134345 - RNA, 19 nt, Human
ucacacucuccaggcugga

SEQ ID NO: 134346 - RNA, 23 nt, Human
ccaucuucuuugcagccugggug

SEQ ID NO: 134347 - RNA, 26 nt, Human
cccaggaaugacccucuaucccagga

SEQ ID NO: 134348 - RNA, 22 nt, Human
accagucugggcaacaugguga

SEQ ID NO: 134349 - RNA, 29 nt, Human
ggagggggagggagaaaauggggcuaugc

SEQ ID NO: 134350 - RNA, 28 nt, Human
cucacguccccugaugcugguaaccuga

SEQ ID NO: 134351 - RNA, 23 nt, Human
gacgggguuucaccauguugguc

SEQ ID NO: 134352 - RNA, 23 nt, Human
gacaggguuucaccauguuaguc

SEQ ID NO: 134353 - RNA, 22 nt, Human
ucccccaccuaccagucaucuu

SEQ ID NO: 134354 - RNA, 23 nt, Human
cacacuuguaguccgagcuacuc

SEQ ID NO: 134355 - RNA, 26 nt, Human
uccuccaugcccucaggcagcagaga

SEQ ID NO: 134356 - RNA, 22 nt, Human
agaccagccugggcuacauagu

SEQ ID NO: 134357 - RNA, 27 nt, Human
gaaaucccuccugauuguagauuuccu

SEQ ID NO: 134358 - RNA, 19 nt, Human
gcuaagcuguuaaauguau

SEQ ID NO: 134359 - RNA, 20 nt, Human
cagaauguuuccuguggaaa

SEQ ID NO: 134360 - RNA, 24 nt, Human
ucacugaagggcuagaguuuuaac

SEQ ID NO: 134361 - RNA, 21 nt, Human
aauugauuucaaucuuagcug

SEQ ID NO: 134362 - RNA, 24 nt, Human
auguguuuacaagggaggauuuua

SEQ ID NO: 134363 - RNA, 22 nt, Human
uucuccuccuccccuucccagu

SEQ ID NO: 134364 - RNA, 20 nt, Human
cucccccuccuccaccccag

SEQ ID NO: 134365 - RNA, 20 nt, Human
ccccucggcguccucucucg

SEQ ID NO: 134366 - RNA, 26 nt, Human
aacucugcuuucugcccaccuuggau

SEQ ID NO: 134367 - RNA, 22 nt, Human
agccguuuauucuuccuuguaa

SEQ ID NO: 134368 - RNA, 26 nt, Human
gagucagaugagcaaggacauugccc

SEQ ID NO: 134369 - RNA, 24 nt, Human
gcauuuuaaaguggaggguuuguc

SEQ ID NO: 134370 - RNA, 19 nt, Human
aucuuuugaaaggcaccag

SEQ ID NO: 134371 - RNA, 26 nt, Human
uccuuucuccccuuuggaugguuggu

SEQ ID NO: 134372 - RNA, 22 nt, Human
acuggccacacuuacuauugac

SEQ ID NO: 134373 - RNA, 23 nt, Human
aauagcacaugauuugggcucua

SEQ ID NO: 134374 - RNA, 29 nt, Human
ggggccuuugguggccacccuggugagga

SEQ ID NO: 134375 - RNA, 24 nt, Human
agagaaccaggaggcagagcggga

SEQ ID NO: 134376 - RNA, 16 nt, Human
gcuggcaaaugccuug

SEQ ID NO: 134377 - RNA, 21 nt, Human
ucuaguucagaagacuaacca

SEQ ID NO: 134378 - RNA, 23 nt, Human
guaagucaggcugaacugcagug

SEQ ID NO: 134379 - RNA, 24 nt, Human
uuuccagcucuccccaugcccccu

SEQ ID NO: 134380 - RNA, 24 nt, Human
ccugguguuuuucucucuggaccc

SEQ ID NO: 134381 - RNA, 22 nt, Human
cuucaucugugagugaaugugu

SEQ ID NO: 134382 - RNA, 22 nt, Human
ccauugcacucccgccugggcg

SEQ ID NO: 134383 - RNA, 22 nt, Human
ugaccaacauggugaaaccuca

SEQ ID NO: 134384 - RNA, 24 nt, Human
gcauuaguugugauuucugccucc

SEQ ID NO: 134385 - RNA, 27 nt, Human
uugcccagcccagcccuagugucaggg

SEQ ID NO: 134386 - RNA, 21 nt, Human
ugggagguugugguugcagug

SEQ ID NO: 134387 - RNA, 21 nt, Human
cucacauugucuuugaaagug

SEQ ID NO: 134388 - RNA, 15 nt, Human
gccauaaaagcuaug

SEQ ID NO: 134389 - RNA, 20 nt, Human
ccucuccccaacccugccgc

SEQ ID NO: 134390 - RNA, 22 nt, Human
caugccccuucugacaccagcu

SEQ ID NO: 134391 - RNA, 19 nt, Human
ccugcauccacacauggcc

SEQ ID NO: 134392 - RNA, 25 nt, Human
gucacccaggcuggagugcaauggc

SEQ ID NO: 134393 - RNA, 20 nt, Human
agaucccuaccugccuggcu

SEQ ID NO: 134394 - RNA, 26 nt, Human
gggaggcgggggccggcgggagccaa

SEQ ID NO: 134395 - RNA, 26 nt, Human
aacaguuauagcuaguggucuugcau

SEQ ID NO: 134396 - RNA, 27 nt, Human
ccccucgggggcugcacacccagcagc

SEQ ID NO: 134397 - RNA, 23 nt, Human
acagccgcggcgggcaggccagg

SEQ ID NO: 134398 - RNA, 27 nt, Human
ggguuggagaauaaaagcaggagaagu

SEQ ID NO: 134399 - RNA, 24 nt, Human
ugcuuuggaaauuuggaagauggu

SEQ ID NO: 134400 - RNA, 22 nt, Human
acacagacacacgcauauucac

SEQ ID NO: 134401 - RNA, 24 nt, Human
cccugcagaggggcuccaggcugg

SEQ ID NO: 134402 - RNA, 20 nt, Human
cuguuugauacaguauuaua

SEQ ID NO: 134403 - RNA, 22 nt, Human
ugaacuccugggcuuaagugac

SEQ ID NO: 134404 - RNA, 21 nt, Human
gcucacugcaagcucuaccuc

SEQ ID NO: 134405 - RNA, 22 nt, Human
ucagaaagaggggaaggaagcc

SEQ ID NO: 134406 - RNA, 28 nt, Human
cccaauccuaguagcugggaguaucagg

SEQ ID NO: 134407 - RNA, 18 nt, Human
cuccauccuccugcccag

SEQ ID NO: 134408 - RNA, 20 nt, Human
gcaaaugacaucacagcagg

SEQ ID NO: 134409 - RNA, 22 nt, Human
ccuacuucuuuuauuccuccuu

SEQ ID NO: 134410 - RNA, 20 nt, Human
gcagaaaagagcacugagag

SEQ ID NO: 134411 - RNA, 21 nt, Human
ucauacagccuugaaaaaagu

SEQ ID NO: 134412 - RNA, 23 nt, Human
auacauguguacauauauauaca

SEQ ID NO: 134413 - RNA, 26 nt, Human
ugcccaggcuggagugcaauagcucg

SEQ ID NO: 134414 - RNA, 24 nt, Human
ucccaaaggacaagcuaauuggaa

SEQ ID NO: 134415 - RNA, 24 nt, Human
uggcagcaggggucagggaagugg

SEQ ID NO: 134416 - RNA, 22 nt, Human
aaauacuggaggcaauuguaaa

SEQ ID NO: 134417 - RNA, 21 nt, Human
gguggaggccacggaggcagg

SEQ ID NO: 134418 - RNA, 24 nt, Human
aggcugcgaccugcaguggcccgu

SEQ ID NO: 134419 - RNA, 22 nt, Human
acaauauagugaaaccccgucu

SEQ ID NO: 134420 - RNA, 25 nt, Human
ggaggacccgcagagguggcagcgg

SEQ ID NO: 134421 - RNA, 22 nt, Human
ccaucucuacuguacucccuca

SEQ ID NO: 134422 - RNA, 20 nt, Human
ugaaaccacuauuuacuuaa

SEQ ID NO: 134423 - RNA, 20 nt, Human
uuuuuuaaagauuuacccua

SEQ ID NO: 134424 - RNA, 23 nt, Human
cagucucuucccagccuggcccu

SEQ ID NO: 134425 - RNA, 24 nt, Human
cuccccaucccccacaguccugga

SEQ ID NO: 134426 - RNA, 23 nt, Human
aagauuccugggcccugccuucc

SEQ ID NO: 134427 - RNA, 21 nt, Human
cccacucaggaggaguggagg

SEQ ID NO: 134428 - RNA, 22 nt, Human
cuagggggaagaaauccuagua

SEQ ID NO: 134429 - RNA, 26 nt, Human
ucuccuccucauccucuucauccuca

SEQ ID NO: 134430 - RNA, 26 nt, Human
ggagugagaggccauagcugucuggc

SEQ ID NO: 134431 - RNA, 24 nt, Human
caguauuuuuaauuaucacuguaa

SEQ ID NO: 134432 - RNA, 22 nt, Human
cccaccccaagccucuccacua

SEQ ID NO: 134433 - RNA, 20 nt, Human
cacgaugacgccucuggacc

SEQ ID NO: 134434 - RNA, 24 nt, Human
gccuugucucccuggcgagugcca

SEQ ID NO: 134435 - RNA, 20 nt, Human
gggccgcaagccccaaaugg

SEQ ID NO: 134436 - RNA, 20 nt, Human
agccuccuggggaggcaggg

SEQ ID NO: 134437 - RNA, 18 nt, Human
aggaagaggaagagugca

SEQ ID NO: 134438 - RNA, 21 nt, Human
ccuuaacugugacacuugcca

SEQ ID NO: 134439 - RNA, 22 nt, Human
gccucauuuaauaacauacucc

SEQ ID NO: 134440 - RNA, 21 nt, Human
ugcucagucacuaauccagcu

SEQ ID NO: 134441 - RNA, 22 nt, Human
cuguagucccagcuacacggga

SEQ ID NO: 134442 - RNA, 22 nt, Human
uuccuagugggcuucucaacuu

SEQ ID NO: 134443 - RNA, 21 nt, Human
aauuauugauaaccucuuccu

SEQ ID NO: 134444 - RNA, 21 nt, Human
cauugcacuccagcugggaga

SEQ ID NO: 134445 - RNA, 22 nt, Human
uucuguaaguggucaaaggaca

SEQ ID NO: 134446 - RNA, 27 nt, Human
ucuuggggccggaggccaguccaaccc

SEQ ID NO: 134447 - RNA, 23 nt, Human
ggaggugucuugaggcucaggga

SEQ ID NO: 134448 - RNA, 20 nt, Human
ugcgaagcuaaugaccugcc

SEQ ID NO: 134449 - RNA, 29 nt, Human
accugccccucaacucuccuccagaguca

SEQ ID NO: 134450 - RNA, 25 nt, Human
cccuccagaauggaacucaagcugg

SEQ ID NO: 134451 - RNA, 26 nt, Human
gccagugagaaccagcaggagaaugu

SEQ ID NO: 134452 - RNA, 24 nt, Human
gccacugcaaacccugcugcugcc

SEQ ID NO: 134453 - RNA, 26 nt, Human
gggaguguaaacugcccccagauguu

SEQ ID NO: 134454 - RNA, 19 nt, Human
cccuggaggagauccaugu

SEQ ID NO: 134455 - RNA, 24 nt, Human
gccagccccagcugcuccuccuca

SEQ ID NO: 134456 - RNA, 23 nt, Human
guaauuccuuauauuucuuucuu

SEQ ID NO: 134457 - RNA, 21 nt, Human
uccacuaacaggaaacacuuc

SEQ ID NO: 134458 - RNA, 22 nt, Human
uucagccucccaaguagcugag

SEQ ID NO: 134459 - RNA, 22 nt, Human
caucucuacaggcacccaucag

SEQ ID NO: 134460 - RNA, 27 nt, Human
ggagggagaggaggggagccaagacac

SEQ ID NO: 134461 - RNA, 26 nt, Human
gagggagggcgacgggggugagaaag

SEQ ID NO: 134462 - RNA, 22 nt, Human
gggacugagaaaccccaaggau

SEQ ID NO: 134463 - RNA, 23 nt, Human
cccugcucuucccgagagcugcc

SEQ ID NO: 134464 - RNA, 21 nt, Human
ucuugguuaaggaaugaauca

SEQ ID NO: 134465 - RNA, 21 nt, Human
ggucucugcauuuuucugcag

SEQ ID NO: 134466 - RNA, 22 nt, Human
ccuguaacucccugccuccucc

SEQ ID NO: 134467 - RNA, 21 nt, Human
uugaaggauuuuuuccagaca

SEQ ID NO: 134468 - RNA, 22 nt, Human
uguaagcuuuuucacuuaguau

SEQ ID NO: 134469 - RNA, 27 nt, Human
guaauuaaaaaauggucagugugcaaa

SEQ ID NO: 134470 - RNA, 20 nt, Human
ucaagcguuuccuggaggac

SEQ ID NO: 134471 - RNA, 22 nt, Human
uuuaaaauguucagguagcagu

SEQ ID NO: 134472 - RNA, 22 nt, Human
gcgggcagaucaccugaggcca

SEQ ID NO: 134473 - RNA, 23 nt, Human
ccucugcugacagcaccucagcu

SEQ ID NO: 134474 - RNA, 32 nt, Human
cccaguguuccaggaaugugaccuuugcugca

SEQ ID NO: 134475 - RNA, 20 nt, Human
ucauuuucucaaagggcaua

SEQ ID NO: 134476 - RNA, 21 nt, Human
uaguuaaugcagaguuaauga

SEQ ID NO: 134477 - RNA, 22 nt, Human
aauguguuuuuuaaauggaacu

SEQ ID NO: 134478 - RNA, 27 nt, Human
cuuuccucugcugucucugcaagauug

SEQ ID NO: 134479 - RNA, 27 nt, Human
uuacuuucauaugaugaaaaugcugug

SEQ ID NO: 134480 - RNA, 20 nt, Human
cucccaggcuggggcagugg

SEQ ID NO: 134481 - RNA, 22 nt, Human
gcauguaugcacacacaugcgc

SEQ ID NO: 134482 - RNA, 21 nt, Human
acuucucucccuuuuucuccc

SEQ ID NO: 134483 - RNA, 26 nt, Human
ccguucccguuuguuagacuaguuuc

SEQ ID NO: 134484 - RNA, 30 nt, Human
gucuguaggccuugucuguuaauaaauagu

SEQ ID NO: 134485 - RNA, 22 nt, Human
cagacuccugggcuuaagggau

SEQ ID NO: 134486 - RNA, 20 nt, Human
gccagcccuggcuggcaugg

SEQ ID NO: 134487 - RNA, 23 nt, Human
cuguggacuucugggauuugcag

SEQ ID NO: 134488 - RNA, 30 nt, Human
caggagggauugaaaggcaucccaguucua

SEQ ID NO: 134489 - RNA, 27 nt, Human
uuuguagaaugaaccacugccccuuca

SEQ ID NO: 134490 - RNA, 27 nt, Human
gcugggccagaccccaggaaggugggg

SEQ ID NO: 134491 - RNA, 22 nt, Human
uggcuggagcaggccucugguc

SEQ ID NO: 134492 - RNA, 22 nt, Human
auucuauggaugucauuauuuu

SEQ ID NO: 134493 - RNA, 27 nt, Human
agcaagacaaagcaaauaaaugccuuc

SEQ ID NO: 134494 - RNA, 19 nt, Human
uuugcugcgugagcauuuu

SEQ ID NO: 134495 - RNA, 17 nt, Human
gcaugagagacccugga

SEQ ID NO: 134496 - RNA, 22 nt, Human
uggauugcugggaauggaagcc

SEQ ID NO: 134497 - RNA, 22 nt, Human
uagcacaaaaugacacucuucu

SEQ ID NO: 134498 - RNA, 22 nt, Human
aggccagccuggccaacauggc

SEQ ID NO: 134499 - RNA, 22 nt, Human
accagccuggucaacauggcga

SEQ ID NO: 134500 - RNA, 22 nt, Human
auagagugcuuauuaaaaggua

SEQ ID NO: 134501 - RNA, 22 nt, Human
acugcaaccucuaccuccuggg

SEQ ID NO: 134502 - RNA, 21 nt, Human
acaaagcauaaucaauauaau

SEQ ID NO: 134503 - RNA, 23 nt, Human
uucuacaagugggugguuuuggu

SEQ ID NO: 134504 - RNA, 23 nt, Human
cgguggugccagagguuuuagga

SEQ ID NO: 134505 - RNA, 22 nt, Human
ugggauugcagauaugagccac

SEQ ID NO: 134506 - RNA, 22 nt, Human
uggugggugccuguaaucccag

SEQ ID NO: 134507 - RNA, 20 nt, Human
acuggaagacagauucugcu

SEQ ID NO: 134508 - RNA, 22 nt, Human
caccaggcuggagugcaguggc

SEQ ID NO: 134509 - RNA, 20 nt, Human
uugcccacuuuucucuuuca

SEQ ID NO: 134510 - RNA, 28 nt, Human
uuggggcugcuccgccuccugaccagcc

SEQ ID NO: 134511 - RNA, 25 nt, Human
cugcagcuuugcuuccaaugugacc

SEQ ID NO: 134512 - RNA, 28 nt, Human
uguucacccaggcugcggagacucaccu

SEQ ID NO: 134513 - RNA, 22 nt, Human
cucaugugcaaacccacucaga

SEQ ID NO: 134514 - RNA, 26 nt, Human
auuuuuaaaaaaugcuuuuaaugcau

SEQ ID NO: 134515 - RNA, 27 nt, Human
uugccuguaugaaugcaucaaguauuc

SEQ ID NO: 134516 - RNA, 22 nt, Human
ggaaggucagcauucaaaguca

SEQ ID NO: 134517 - RNA, 27 nt, Human
gacaagcucaguuuucucugaaggaga

SEQ ID NO: 134518 - RNA, 20 nt, Human
auggaaaugaucuguauuga

SEQ ID NO: 134519 - RNA, 24 nt, Human
cagcaguagacaaauggauacuga

SEQ ID NO: 134520 - RNA, 27 nt, Human
cccaggaggcgacugcaugguggagag

SEQ ID NO: 134521 - RNA, 22 nt, Human
aaggcggccagguuugcagugc

SEQ ID NO: 134522 - RNA, 21 nt, Human
gggcagcuccacagggcaggg

SEQ ID NO: 134523 - RNA, 27 nt, Human
uccgugguaauaggcacauuuugaaac

SEQ ID NO: 134524 - RNA, 23 nt, Human
ccagccuggcccuggcaaggggc

SEQ ID NO: 134525 - RNA, 23 nt, Human
uuggugcucucaccuuaucugga

SEQ ID NO: 134526 - RNA, 20 nt, Human
gccuggacccagcacugugg

SEQ ID NO: 134527 - RNA, 24 nt, Human
cugcauuuccuaucuuccuguguc

SEQ ID NO: 134528 - RNA, 21 nt, Human
cagcuuuaauggaauauuggg

SEQ ID NO: 134529 - RNA, 26 nt, Human
uugcccaggccuggacuuuuugcauc

SEQ ID NO: 134530 - RNA, 23 nt, Human
gucauuaaugggcaggcuuuucu

SEQ ID NO: 134531 - RNA, 21 nt, Human
ccgcugccgccuuccccauca

SEQ ID NO: 134532 - RNA, 21 nt, Human
ugggugcugucaugcccagcu

SEQ ID NO: 134533 - RNA, 22 nt, Human
ccuccaucuguucccagcaccg

SEQ ID NO: 134534 - RNA, 24 nt, Human
uuuuccuuuggaauuucugcuuua

SEQ ID NO: 134535 - RNA, 21 nt, Human
guuggaaguguggaaaggagg

SEQ ID NO: 134536 - RNA, 19 nt, Human
guguccuugguuucacugg

SEQ ID NO: 134537 - RNA, 26 nt, Human
uggggaggcaggcggggcugacagcu

SEQ ID NO: 134538 - RNA, 23 nt, Human
cuccaccucccaaaguguuagaa

SEQ ID NO: 134539 - RNA, 27 nt, Human
ucagcucccaguccuugugcuuuuugg

SEQ ID NO: 134540 - RNA, 22 nt, Human
uggcccaggcuggagugcagug

SEQ ID NO: 134541 - RNA, 27 nt, Human
cgggcagcagcugugugcgggccuggg

SEQ ID NO: 134542 - RNA, 19 nt, Human
ccuccugccuacuccagcc

SEQ ID NO: 134543 - RNA, 23 nt, Human
gcugccuuauauuccuacauucc

SEQ ID NO: 134544 - RNA, 26 nt, Human
agccagccacugcuguggcccugccc

SEQ ID NO: 134545 - RNA, 19 nt, Human
accaugaaagaaguugaag

SEQ ID NO: 134546 - RNA, 25 nt, Human
uucuuauugcaaagcuucagucaga

SEQ ID NO: 134547 - RNA, 27 nt, Human
aaagcagcuugcguugacagccugggg

SEQ ID NO: 134548 - RNA, 22 nt, Human
cagaaauuggagaaaaugcuuu

SEQ ID NO: 134549 - RNA, 25 nt, Human
ccacaaacaagaauacagguaucuu

SEQ ID NO: 134550 - RNA, 23 nt, Human
uaucuguguuuguguuggcaugc

SEQ ID NO: 134551 - RNA, 22 nt, Human
cucuuauucuagcacagugccu

SEQ ID NO: 134552 - RNA, 22 nt, Human
aucaugguuuuugcucuacuuu

SEQ ID NO: 134553 - RNA, 23 nt, Human
ucucacccucuccuguuguaucc

SEQ ID NO: 134554 - RNA, 22 nt, Human
cacgccuguaauccuagcacuu

SEQ ID NO: 134555 - RNA, 20 nt, Human
ugaggagacguggagaggag

SEQ ID NO: 134556 - RNA, 25 nt, Human
ucaacaucucaggaaaaucugugau

SEQ ID NO: 134557 - RNA, 22 nt, Human
ugguaucucccauaauacgacc

SEQ ID NO: 134558 - RNA, 26 nt, Human
acucacugcaugacccuuucuguaua

SEQ ID NO: 134559 - RNA, 21 nt, Human
gcuggacaugguggcucagcu

SEQ ID NO: 134560 - RNA, 22 nt, Human
ggugcccgccaccacacccaac

SEQ ID NO: 134561 - RNA, 19 nt, Human
ugucaggcugggguuagug

SEQ ID NO: 134562 - RNA, 23 nt, Human
gggucgagccuaggggagcuuga

SEQ ID NO: 134563 - RNA, 18 nt, Human
ccagcaccaccaugucgc

SEQ ID NO: 134564 - RNA, 26 nt, Human
ccucaccucuguucuuccuauuucug

SEQ ID NO: 134565 - RNA, 27 nt, Human
ccaggaggcagggagcagccgccccau

SEQ ID NO: 134566 - RNA, 20 nt, Human
gcuucuggagguggggaggg

SEQ ID NO: 134567 - RNA, 20 nt, Human
augcccaggcccugcauuuu

SEQ ID NO: 134568 - RNA, 28 nt, Human
acaggcacugggacaucacaggcuucag

SEQ ID NO: 134569 - RNA, 27 nt, Human
gggcuuugcagggcggccagugcagug

SEQ ID NO: 134570 - RNA, 20 nt, Human
uuaguguugagccucuggau

SEQ ID NO: 134571 - RNA, 20 nt, Human
caggcagcucuagucaguga

SEQ ID NO: 134572 - RNA, 22 nt, Human
aaccuguuucacucaaugccag

SEQ ID NO: 134573 - RNA, 25 nt, Human
uugccucuguccugccuggugugga

SEQ ID NO: 134574 - RNA, 21 nt, Human
cccugcccugcuccuaagggu

SEQ ID NO: 134575 - RNA, 20 nt, Human
aaaugcacgcacacgcacag

SEQ ID NO: 134576 - RNA, 21 nt, Human
uugucgccccuccuuuuucug

SEQ ID NO: 134577 - RNA, 20 nt, Human
cugacucccagcuauagcca

SEQ ID NO: 134578 - RNA, 23 nt, Human
uagacagcuuuucucaacugggu

SEQ ID NO: 134579 - RNA, 26 nt, Human
gcaggcuuuuuggugcuaggcccugg

SEQ ID NO: 134580 - RNA, 27 nt, Human
uucucauuccuucuauggcugcaagua

SEQ ID NO: 134581 - RNA, 21 nt, Human
ucuggcuaccacgucuuugga

SEQ ID NO: 134582 - RNA, 21 nt, Human
aggcugaggucuggagccagg

SEQ ID NO: 134583 - RNA, 31 nt, Human
ugagaaaguacaaacuucuccuaugucuuuc

SEQ ID NO: 134584 - RNA, 20 nt, Human
uuugaggcagggcucagugg

SEQ ID NO: 134585 - RNA, 23 nt, Human
cgaguagcugggauuccaggcgc

SEQ ID NO: 134586 - RNA, 24 nt, Human
agauuguuuugauuuaggccaggu

SEQ ID NO: 134587 - RNA, 22 nt, Human
ugaaagcuuuggcaaccccaau

SEQ ID NO: 134588 - RNA, 25 nt, Human
ccuucugcugccccggaguccccuc

SEQ ID NO: 134589 - RNA, 26 nt, Human
ccuugauauguaguaagcgugauuca

SEQ ID NO: 134590 - RNA, 27 nt, Human
aaggacacagacaaggaacuugcugaa

SEQ ID NO: 134591 - RNA, 23 nt, Human
uaucuccuccuccgccuguguaa

SEQ ID NO: 134592 - RNA, 26 nt, Human
acccaggcugagggugccuuuguggc

SEQ ID NO: 134593 - RNA, 21 nt, Human
gaggcugaggugguaggauca

SEQ ID NO: 134594 - RNA, 21 nt, Human
aauuuuuuggugaaguacuga

SEQ ID NO: 134595 - RNA, 21 nt, Human
cagcgggccagcagcccaggg

SEQ ID NO: 134596 - RNA, 27 nt, Human
gcuggcuuugugaaaugaauugagaag

SEQ ID NO: 134597 - RNA, 23 nt, Human
acaaguguucggagggcagcaga

SEQ ID NO: 134598 - RNA, 20 nt, Human
gguguuuucacacgucuuuu

SEQ ID NO: 134599 - RNA, 23 nt, Human
cggagagacuacugaccuucuca

SEQ ID NO: 134600 - RNA, 23 nt, Human
gaauguggaggacagugccaggc

SEQ ID NO: 134601 - RNA, 26 nt, Human
ggaaggggacaggauugucugcugcc

SEQ ID NO: 134602 - RNA, 23 nt, Human
aggaucucaggcuggagugcagu

SEQ ID NO: 134603 - RNA, 20 nt, Human
uucaguuaaacacugcugca

SEQ ID NO: 134604 - RNA, 23 nt, Human
guagagagaaacuaccuaccuca

SEQ ID NO: 134605 - RNA, 24 nt, Human
gggcuucguuucugcucuccccgg

SEQ ID NO: 134606 - RNA, 21 nt, Human
gguugcagauugaagcauuuc

SEQ ID NO: 134607 - RNA, 22 nt, Human
caccacacaccccgccccugaa

SEQ ID NO: 134608 - RNA, 22 nt, Human
cagggcugggacaauggcagug

SEQ ID NO: 134609 - RNA, 26 nt, Human
gcagccgccucuucccucucgaagca

SEQ ID NO: 134610 - RNA, 22 nt, Human
gaagaaaaagaaggacugaacu

SEQ ID NO: 134611 - RNA, 22 nt, Human
gcaugccacagccacucgccuu

SEQ ID NO: 134612 - RNA, 22 nt, Human
gugugacucccauggggaggaa

SEQ ID NO: 134613 - RNA, 23 nt, Human
cuguaaaauggaagcgguuggac

SEQ ID NO: 134614 - RNA, 20 nt, Human
aacauaggugguucugugau

SEQ ID NO: 134615 - RNA, 21 nt, Human
ccucuacuuggccuauuugcc

SEQ ID NO: 134616 - RNA, 23 nt, Human
cacugcucucaccagaacugaga

SEQ ID NO: 134617 - RNA, 23 nt, Human
cuggagggcuagaaccuggaggg

SEQ ID NO: 134618 - RNA, 20 nt, Human
gcaugacaagcuccagcauc

SEQ ID NO: 134619 - RNA, 24 nt, Human
uacuguuucucaaguguuuuggag

SEQ ID NO: 134620 - RNA, 21 nt, Human
acuucuuaauuuaugaccuca

SEQ ID NO: 134621 - RNA, 20 nt, Human
gcauuuucuguuugccccca

SEQ ID NO: 134622 - RNA, 23 nt, Human
uauagaagaucauaaagcuuuaa

SEQ ID NO: 134623 - RNA, 23 nt, Human
cuguaaaaauaggauggcgaguu

SEQ ID NO: 134624 - RNA, 26 nt, Human
cacuucagaagccuacuggggaaggc

SEQ ID NO: 134625 - RNA, 21 nt, Human
ccaaauggacauuucucuaaa

SEQ ID NO: 134626 - RNA, 23 nt, Human
ugacugccugcagaagucccaag

SEQ ID NO: 134627 - RNA, 21 nt, Human
cuugcugugggaugugccagu

SEQ ID NO: 134628 - RNA, 21 nt, Human
agggagggcaggguggggcug

SEQ ID NO: 134629 - RNA, 20 nt, Human
ggagaaacugaacugagaag

SEQ ID NO: 134630 - RNA, 26 nt, Human
cuccucccuccugccgacuccugggu

SEQ ID NO: 134631 - RNA, 27 nt, Human
uggucucacggggcuaguuuugacccc

SEQ ID NO: 134632 - RNA, 25 nt, Human
gugaggaagagcaggcaccagcagc

SEQ ID NO: 134633 - RNA, 23 nt, Human
ucugggcagcuaaaagcaucccu

SEQ ID NO: 134634 - RNA, 19 nt, Human
uugugauuuuauuuuuugu

SEQ ID NO: 134635 - RNA, 20 nt, Human
cacccagguuuggagguccu

SEQ ID NO: 134636 - RNA, 22 nt, Human
guagggagggggugguuaucgc

SEQ ID NO: 134637 - RNA, 27 nt, Human
caggcuggagugcaguggugagaucug

SEQ ID NO: 134638 - RNA, 22 nt, Human
aggagccuauauaaauauaaac

SEQ ID NO: 134639 - RNA, 22 nt, Human
ugucaccaaggcuuagugcagu

SEQ ID NO: 134640 - RNA, 20 nt, Human
ggaacaagaaagcuaauaaa

SEQ ID NO: 134641 - RNA, 19 nt, Human
aaauucucgaagcuuuuca

SEQ ID NO: 134642 - RNA, 26 nt, Human
caguguccguguuaauguauuuggcu

SEQ ID NO: 134643 - RNA, 23 nt, Human
gucaugccacugcacucuagccu

SEQ ID NO: 134644 - RNA, 23 nt, Human
auccuggaggcuacacagcugcc

SEQ ID NO: 134645 - RNA, 20 nt, Human
uucaaguguucaccaaccac

SEQ ID NO: 134646 - RNA, 21 nt, Human
cccgcacuccccuuuuauacc

SEQ ID NO: 134647 - RNA, 20 nt, Human
aggaauuaggaauccugcug

SEQ ID NO: 134648 - RNA, 21 nt, Human
caccccaccauccacauguau

SEQ ID NO: 134649 - RNA, 24 nt, Human
cccuuucugggucccuccugguuc

SEQ ID NO: 134650 - RNA, 19 nt, Human
cccgagcuggagugcagug

SEQ ID NO: 134651 - RNA, 21 nt, Human
ugcucugcaagcccacuggcc

SEQ ID NO: 134652 - RNA, 23 nt, Human
accuguuuucgcaccuaccauca

SEQ ID NO: 134653 - RNA, 23 nt, Human
ucccauguuaaaucccauucaua

SEQ ID NO: 134654 - RNA, 27 nt, Human
cgggaaagacuggagcagcgaacagga

SEQ ID NO: 134655 - RNA, 18 nt, Human
cggcuccugucauccccu

SEQ ID NO: 134656 - RNA, 25 nt, Human
cuggaggcaagguucgacugcagcc

SEQ ID NO: 134657 - RNA, 26 nt, Human
cagggcagagaggucagggcagagag

SEQ ID NO: 134658 - RNA, 21 nt, Human
agaggucaagguugcagugag

SEQ ID NO: 134659 - RNA, 21 nt, Human
ggucaagccucuuauuccagg

SEQ ID NO: 134660 - RNA, 24 nt, Human
aaaaagaguuaagcaguucgacaa

SEQ ID NO: 134661 - RNA, 22 nt, Human
ccaaagugcugggauuaugggc

SEQ ID NO: 134662 - RNA, 22 nt, Human
ccaaagugccaggauuacaggc

SEQ ID NO: 134663 - RNA, 19 nt, Human
ccugcauuguucuuugcca

SEQ ID NO: 134664 - RNA, 23 nt, Human
guguccuuaaacuuccaaucuua

SEQ ID NO: 134665 - RNA, 26 nt, Human
ggggccucccuucccaccugccugug

SEQ ID NO: 134666 - RNA, 23 nt, Human
cugggauaaagcaagaagacuga

SEQ ID NO: 134667 - RNA, 27 nt, Human
ugcuguugcugcucuguauuugccucu

SEQ ID NO: 134668 - RNA, 22 nt, Human
caggcuggagugcaauggcagg

SEQ ID NO: 134669 - RNA, 23 nt, Human
uccuacuguaccucgugccugcu

SEQ ID NO: 134670 - RNA, 27 nt, Human
gguuucuucagaaucaugaaguucuuu

SEQ ID NO: 134671 - RNA, 20 nt, Human
ugugaagauucaguucaaau

SEQ ID NO: 134672 - RNA, 24 nt, Human
ccagcacuucgcuugcagaagcca

SEQ ID NO: 134673 - RNA, 21 nt, Human
ugcaugggcuaauuaucauca

SEQ ID NO: 134674 - RNA, 28 nt, Human
ucacauuuuuacaaauagguagagucau

SEQ ID NO: 134675 - RNA, 22 nt, Human
ccccacuggcugccugggagcc

SEQ ID NO: 134676 - RNA, 23 nt, Human
aucgcaccacugcucuccagccu

SEQ ID NO: 134677 - RNA, 22 nt, Human
uggaagguacaucagcaauuaa

SEQ ID NO: 134678 - RNA, 20 nt, Human
uguuacccagggcucugcag

SEQ ID NO: 134679 - RNA, 27 nt, Human
aaagugcugggauuacaggagugugcc

SEQ ID NO: 134680 - RNA, 21 nt, Human
gugaaggaagagaaggccagc

SEQ ID NO: 134681 - RNA, 22 nt, Human
caagaucaugcuacugcacucc

SEQ ID NO: 134682 - RNA, 25 nt, Human
cuagggaggcugaggcaggagaauc

SEQ ID NO: 134683 - RNA, 25 nt, Human
aagacccuggcuuucauuuucucuc

SEQ ID NO: 134684 - RNA, 18 nt, Human
cugucauguaagaggugc

SEQ ID NO: 134685 - RNA, 22 nt, Human
cacacacgcauuauuuuuguua

SEQ ID NO: 134686 - RNA, 18 nt, Human
aagggagggagcugaggc

SEQ ID NO: 134687 - RNA, 20 nt, Human
uuugcugcugcuucccucuc

SEQ ID NO: 134688 - RNA, 22 nt, Human
uuuugcccuccccuucuccucc

SEQ ID NO: 134689 - RNA, 25 nt, Human
uucauuucuguaaaacacuuguuuu

SEQ ID NO: 134690 - RNA, 20 nt, Human
aaacauuuuugcuuucucca

SEQ ID NO: 134691 - RNA, 23 nt, Human
cccaccccaggcugggcuguuca

SEQ ID NO: 134692 - RNA, 18 nt, Human
ggcggucaccaccaccac

SEQ ID NO: 134693 - RNA, 24 nt, Human
ggaagagagguugagucacccauc

SEQ ID NO: 134694 - RNA, 24 nt, Human
auugcuggcccagcuccugaggcu

SEQ ID NO: 134695 - RNA, 20 nt, Human
uggugaaauggcuccagagg

SEQ ID NO: 134696 - RNA, 29 nt, Human
gugcccaggaggcaggcagugcggggugc

SEQ ID NO: 134697 - RNA, 21 nt, Human
uccccuccccucugcccuguu

SEQ ID NO: 134698 - RNA, 21 nt, Human
cagaaaaauauuaagaagaaa

SEQ ID NO: 134699 - RNA, 23 nt, Human
gauaucaagaaauuuucuuuuug

SEQ ID NO: 134700 - RNA, 20 nt, Human
cggcgggcagaggagaggga

SEQ ID NO: 134701 - RNA, 20 nt, Human
ugucuggaagccccaugaga

SEQ ID NO: 134702 - RNA, 24 nt, Human
gccucaagaagcugaugguggcac

SEQ ID NO: 134703 - RNA, 21 nt, Human
cagucucuccacugugguuuc

SEQ ID NO: 134704 - RNA, 24 nt, Human
agcacccucccccgcagcggggua

SEQ ID NO: 134705 - RNA, 22 nt, Human
aggcugcaaucucugcacuuug

SEQ ID NO: 134706 - RNA, 24 nt, Human
uucccaggaguuagagggaugcga

SEQ ID NO: 134707 - RNA, 30 nt, Human
aacacccuucucggaggcucaggucaagug

SEQ ID NO: 134708 - RNA, 26 nt, Human
cucagggcagcugaugaggggucagc

SEQ ID NO: 134709 - RNA, 22 nt, Human
gagccccagaggcagagguugu

SEQ ID NO: 134710 - RNA, 21 nt, Human
aaaugaacacaccacucugag

SEQ ID NO: 134711 - RNA, 21 nt, Human
gucucugccuugagucaucua

SEQ ID NO: 134712 - RNA, 29 nt, Human
gcugcuggccgcggugguggaggcguucu

SEQ ID NO: 134713 - RNA, 27 nt, Human
cuaaggcaggagaaucacuucagcccg

SEQ ID NO: 134714 - RNA, 20 nt, Human
cacccuaccagcuccuccag

SEQ ID NO: 134715 - RNA, 21 nt, Human
acucaaggaggucaaguugag

SEQ ID NO: 134716 - RNA, 21 nt, Human
gagcugaugggagcagcuggu

SEQ ID NO: 134717 - RNA, 21 nt, Human
gcauuacucugcacuauagcc

SEQ ID NO: 134718 - RNA, 22 nt, Human
cucccuguucuguccuagcuau

SEQ ID NO: 134719 - RNA, 27 nt, Human
gauucacagaguuaguaauacccagaa

SEQ ID NO: 134720 - RNA, 27 nt, Human
uucauucuuucacuguuuguaucugcg

SEQ ID NO: 134721 - RNA, 19 nt, Human
uaaggacaauguaacucua

SEQ ID NO: 134722 - RNA, 25 nt, Human
ucuccugcccuuguuccuggcagca

SEQ ID NO: 134723 - RNA, 27 nt, Human
caggcuggagcccggagggucugcugg

SEQ ID NO: 134724 - RNA, 26 nt, Human
ugcuaaaacugaagcaccacugugug

SEQ ID NO: 134725 - RNA, 18 nt, Human
ugcuagugcuguaauauu

SEQ ID NO: 134726 - RNA, 23 nt, Human
uuuacauucuguguguaucuaaa

SEQ ID NO: 134727 - RNA, 22 nt, Human
ccuuccuguccugucucaggcc

SEQ ID NO: 134728 - RNA, 21 nt, Human
acuauacauugaaaugccugc

SEQ ID NO: 134729 - RNA, 21 nt, Human
gcucccagcaucaucuuccua

SEQ ID NO: 134730 - RNA, 21 nt, Human
auuggaaagcagccuggccaa

SEQ ID NO: 134731 - RNA, 18 nt, Human
uggguuucaugagcuugg

SEQ ID NO: 134732 - RNA, 26 nt, Human
gagugaggcgccuguacugucuuucu

SEQ ID NO: 134733 - RNA, 21 nt, Human
aguuuccuuccuuccuucucg

SEQ ID NO: 134734 - RNA, 21 nt, Human
aggggagucccugggcagacu

SEQ ID NO: 134735 - RNA, 22 nt, Human
gccugugauccuagcacuuugc

SEQ ID NO: 134736 - RNA, 21 nt, Human
agaucccgaagcacagagaca

SEQ ID NO: 134737 - RNA, 26 nt, Human
ccuuggcugcucacuguccacaugug

SEQ ID NO: 134738 - RNA, 23 nt, Human
gaaaagcucuugaauauaagcaa

SEQ ID NO: 134739 - RNA, 19 nt, Human
ucuacuuuaauucauugga

SEQ ID NO: 134740 - RNA, 22 nt, Human
agaggaggaagagggagucugg

SEQ ID NO: 134741 - RNA, 27 nt, Human
cugacuuucauuucuugagguacucug

SEQ ID NO: 134742 - RNA, 25 nt, Human
ccgugccuggcucuucuugccucgc

SEQ ID NO: 134743 - RNA, 27 nt, Human
agccuccucuccagguuccugcccugc

SEQ ID NO: 134744 - RNA, 20 nt, Human
ggagagaaggauucuagggg

SEQ ID NO: 134745 - RNA, 26 nt, Human
caccacacaccucccagcucugcaga

SEQ ID NO: 134746 - RNA, 27 nt, Human
cacugccugcuggaagcucugugggaa

SEQ ID NO: 134747 - RNA, 22 nt, Human
ccauaaaauauauauuucugcu

SEQ ID NO: 134748 - RNA, 20 nt, Human
ggaaguggcaguugcaguga

SEQ ID NO: 134749 - RNA, 22 nt, Human
ccaccuccuggguucaagcaau

SEQ ID NO: 134750 - RNA, 20 nt, Human
uucucucuuugaagagagca

SEQ ID NO: 134751 - RNA, 25 nt, Human
ucugcuccccagugcuaccucucuc

SEQ ID NO: 134752 - RNA, 27 nt, Human
ccauugcauuccagccuaggcaacacg

SEQ ID NO: 134753 - RNA, 21 nt, Human
ccaggcugucauuccaggaag

SEQ ID NO: 134754 - RNA, 22 nt, Human
gcacuguuagacacacauagac

SEQ ID NO: 134755 - RNA, 23 nt, Human
uauucccuauaggcagcuggaga

SEQ ID NO: 134756 - RNA, 21 nt, Human
ggguucagcacccaccuuucu

SEQ ID NO: 134757 - RNA, 24 nt, Human
acccccucucuuuucuuuuagcuc

SEQ ID NO: 134758 - RNA, 21 nt, Human
cuccuaagcuggagugcagug

SEQ ID NO: 134759 - RNA, 23 nt, Human
gagccuaagccaccucucuaccu

SEQ ID NO: 134760 - RNA, 21 nt, Human
ccuucgcuccuccucucauca

SEQ ID NO: 134761 - RNA, 24 nt, Human
acuauaggaaucagaaaaauucaa

SEQ ID NO: 134762 - RNA, 21 nt, Human
caguuaccaccuccugccuca

SEQ ID NO: 134763 - RNA, 23 nt, Human
ucuuguccaggcuggagugcaau

SEQ ID NO: 134764 - RNA, 22 nt, Human
ugaacucccaaccucaagcaau

SEQ ID NO: 134765 - RNA, 21 nt, Human
auugcugaauucuaaauaaug

SEQ ID NO: 134766 - RNA, 22 nt, Human
cagguugggcgcguuuggugca

SEQ ID NO: 134767 - RNA, 22 nt, Human
gcccaaauaggaggaaaacaca

SEQ ID NO: 134768 - RNA, 20 nt, Human
gguuacuucuccccuggguc

SEQ ID NO: 134769 - RNA, 21 nt, Human
gcaagcccagaagcaucugca

SEQ ID NO: 134770 - RNA, 20 nt, Human
ccucacuugccucugccucc

SEQ ID NO: 134771 - RNA, 30 nt, Human
gcacccccucccacuggagugcggggaccu

SEQ ID NO: 134772 - RNA, 21 nt, Human
ccaucucacuggcucugaggg

SEQ ID NO: 134773 - RNA, 22 nt, Human
agaccagccuggccaacaugga

SEQ ID NO: 134774 - RNA, 21 nt, Human
caucuaggcuaggugcagugg

SEQ ID NO: 134775 - RNA, 27 nt, Human
ccauaaaugugugccaagagggucucc

SEQ ID NO: 134776 - RNA, 23 nt, Human
gauccuugccacugcucuucccu

SEQ ID NO: 134777 - RNA, 23 nt, Human
cuggagcgaggggcagggaugag

SEQ ID NO: 134778 - RNA, 19 nt, Human
ccuuggcccucuuuccucu

SEQ ID NO: 134779 - RNA, 27 nt, Human
agggcuccagacccaaccuggucacaa

SEQ ID NO: 134780 - RNA, 24 nt, Human
gcguguggcaucuccaccucaagg

SEQ ID NO: 134781 - RNA, 27 nt, Human
ugucuuugucacaaagaacuuuccucu

SEQ ID NO: 134782 - RNA, 19 nt, Human
aauauugcuuucaaaaaga

SEQ ID NO: 134783 - RNA, 27 nt, Human
ugccugcucucaagagcacuuacugcc

SEQ ID NO: 134784 - RNA, 21 nt, Human
cgcacaggcuggagugcagug

SEQ ID NO: 134785 - RNA, 22 nt, Human
guuggccaggcugguggugagc

SEQ ID NO: 134786 - RNA, 25 nt, Human
ccugcccucugucugucuucuccua

SEQ ID NO: 134787 - RNA, 24 nt, Human
uugcccagugcugccagagugagu

SEQ ID NO: 134788 - RNA, 27 nt, Human
augagacaacacuauuuuuauuuauau

SEQ ID NO: 134789 - RNA, 26 nt, Human
uguuuccugucugauagcaccacacg

SEQ ID NO: 134790 - RNA, 24 nt, Human
ccugggagguugaggcuucugugc

SEQ ID NO: 134791 - RNA, 27 nt, Human
gauaccuugaaaggaagagcuaauaaa

SEQ ID NO: 134792 - RNA, 27 nt, Human
ugaggcuucauaaucauggcucuuaga

SEQ ID NO: 134793 - RNA, 22 nt, Human
ucugugggggucaucagggagg

SEQ ID NO: 134794 - RNA, 23 nt, Human
ggccacgcuguggggccaccuca

SEQ ID NO: 134795 - RNA, 22 nt, Human
uuugggccuccaugccccagcu

SEQ ID NO: 134796 - RNA, 19 nt, Human
auuugguauccugauuuau

SEQ ID NO: 134797 - RNA, 22 nt, Human
cucagccgccgggagcacccag

SEQ ID NO: 134798 - RNA, 22 nt, Human
ccacucuccacuuucucucaca

SEQ ID NO: 134799 - RNA, 22 nt, Human
gcggcagagucacgguggcagc

SEQ ID NO: 134800 - RNA, 27 nt, Human
ccccucgggccaggcaacagaacuugu

SEQ ID NO: 134801 - RNA, 22 nt, Human
cugcuuguagaaaccauuugca

SEQ ID NO: 134802 - RNA, 24 nt, Human
auaucaguuacaguggcaguauug

SEQ ID NO: 134803 - RNA, 22 nt, Human
cccuucuccucuccccagggcc

SEQ ID NO: 134804 - RNA, 18 nt, Human
gguuuucugcucugucca

SEQ ID NO: 134805 - RNA, 19 nt, Human
cuguggaaugagcucuguu

SEQ ID NO: 134806 - RNA, 22 nt, Human
cucagccucccaaguggcuggg

SEQ ID NO: 134807 - RNA, 20 nt, Human
gccauaaaauauuuuccuuc

SEQ ID NO: 134808 - RNA, 28 nt, Human
agacuagcaaucucuucauuauucucug

SEQ ID NO: 134809 - RNA, 23 nt, Human
cacauacacacugucaugcacuc

SEQ ID NO: 134810 - RNA, 26 nt, Human
gggaaagaucagagaggcagaggugg

SEQ ID NO: 134811 - RNA, 24 nt, Human
ccuaagauacugcuaucauucuuc

SEQ ID NO: 134812 - RNA, 22 nt, Human
gcugggugguugagugagugaa

SEQ ID NO: 134813 - RNA, 22 nt, Human
agccuccaggauaccagcaaau

SEQ ID NO: 134814 - RNA, 20 nt, Human
gacaaccaaaggaaaauggg

SEQ ID NO: 134815 - RNA, 25 nt, Human
uugaguguguugggcuuuggguaua

SEQ ID NO: 134816 - RNA, 25 nt, Human
cccugucugcucacuucuagcuauu

SEQ ID NO: 134817 - RNA, 28 nt, Human
uuugcuuuccuguucccuagcuagcuag

SEQ ID NO: 134818 - RNA, 31 nt, Human
ugccauugccagugggacgucugagacuuuc

SEQ ID NO: 134819 - RNA, 21 nt, Human
ucacccaggcuguggugcagu

SEQ ID NO: 134820 - RNA, 27 nt, Human
cccucauuccucccaggaauuaauaaa

SEQ ID NO: 134821 - RNA, 23 nt, Human
aacucugcacuacuccucugcag

SEQ ID NO: 134822 - RNA, 32 nt, Human
gcuccuaaacugagcugccucuaccacagccu

SEQ ID NO: 134823 - RNA, 22 nt, Human
ucucgcuucuguccuccguuua

SEQ ID NO: 134824 - RNA, 23 nt, Human
uauaaaugaucuacauguucaga

SEQ ID NO: 134825 - RNA, 25 nt, Human
ucgcucugucgccaggcuggagugc

SEQ ID NO: 134826 - RNA, 23 nt, Human
uucuccucuccccaauccaugcu

SEQ ID NO: 134827 - RNA, 27 nt, Human
ggcuucaucugcaaagggcccuuucau

SEQ ID NO: 134828 - RNA, 26 nt, Human
ugucucccaggcugcuggagugcagu

SEQ ID NO: 134829 - RNA, 23 nt, Human
gcagcugcugccuuccauuccuc

SEQ ID NO: 134830 - RNA, 23 nt, Human
aggcugcuaucguuccaugugua

SEQ ID NO: 134831 - RNA, 21 nt, Human
cguccaccccuccgcgcuggc

SEQ ID NO: 134832 - RNA, 26 nt, Human
gguauuuuugaagugguguagaaccc

SEQ ID NO: 134833 - RNA, 24 nt, Human
cacgccuggcccggucagugcugc

SEQ ID NO: 134834 - RNA, 22 nt, Human
gugacuauucauggcuaccuca

SEQ ID NO: 134835 - RNA, 22 nt, Human
gggcucaagcgauucuccagcc

SEQ ID NO: 134836 - RNA, 20 nt, Human
cagggucccugaggugaagu

SEQ ID NO: 134837 - RNA, 23 nt, Human
cugcaggccugggaaggcagcaa

SEQ ID NO: 134838 - RNA, 21 nt, Human
caaaacugagauaauuuagaa

SEQ ID NO: 134839 - RNA, 27 nt, Human
ucagcacuggcuuucuguuuucacaag

SEQ ID NO: 134840 - RNA, 22 nt, Human
gugguuaagacuuccaagccag

SEQ ID NO: 134841 - RNA, 20 nt, Human
cccaucuccccuggggagcc

SEQ ID NO: 134842 - RNA, 28 nt, Human
ccuggugcccuguggcccccacccaccu

SEQ ID NO: 134843 - RNA, 21 nt, Human
aggacccccaacaaccccaau

SEQ ID NO: 134844 - RNA, 21 nt, Human
gcuuuggaaguccaaaaagaa

SEQ ID NO: 134845 - RNA, 22 nt, Human
uuuacauuuacugaauaagauu

SEQ ID NO: 134846 - RNA, 24 nt, Human
gauuauuaaaaugacauguauuua

SEQ ID NO: 134847 - RNA, 27 nt, Human
caguacuucauuuuuaauuguuuucua

SEQ ID NO: 134848 - RNA, 22 nt, Human
uuuaauaagccucuuccuacua

SEQ ID NO: 134849 - RNA, 21 nt, Human
ggccugacccucagcacuuuc

SEQ ID NO: 134850 - RNA, 22 nt, Human
ugggaauggaaagaacuacaga

SEQ ID NO: 134851 - RNA, 21 nt, Human
cagcccaggcagccagcuuug

SEQ ID NO: 134852 - RNA, 24 nt, Human
ucugucgccaggcuagagugcggu

SEQ ID NO: 134853 - RNA, 26 nt, Human
gagucaugcuggaggagaaggaagua

SEQ ID NO: 134854 - RNA, 27 nt, Human
caaacuaacugcaguaacagaaaccuu

SEQ ID NO: 134855 - RNA, 20 nt, Human
caucuuccaguaauucgcca

SEQ ID NO: 134856 - RNA, 18 nt, Human
uuuacacccugacugugc

SEQ ID NO: 134857 - RNA, 17 nt, Human
ccagaugccacucugca

SEQ ID NO: 134858 - RNA, 21 nt, Human
ucucauaagcacugcuuugcu

SEQ ID NO: 134859 - RNA, 22 nt, Human
agaccagccuggccaauacggc

SEQ ID NO: 134860 - RNA, 25 nt, Human
uugcccaggcuggaguucagcggug

SEQ ID NO: 134861 - RNA, 17 nt, Human
agauguuuuaagaaaga

SEQ ID NO: 134862 - RNA, 25 nt, Human
uuucuucuuuucucccagucuccug

SEQ ID NO: 134863 - RNA, 23 nt, Human
cucuguccccaaaggacgccugc

SEQ ID NO: 134864 - RNA, 20 nt, Human
uacugugaauucauuacgaa

SEQ ID NO: 134865 - RNA, 22 nt, Human
acccugugagaacaagccccuc

SEQ ID NO: 134866 - RNA, 22 nt, Human
ggcuucccaaagugcugggauu

SEQ ID NO: 134867 - RNA, 27 nt, Human
ggggagggagaaauuaagcggauuccc

SEQ ID NO: 134868 - RNA, 27 nt, Human
ccccucggguggcccccuuugccacgu

SEQ ID NO: 134869 - RNA, 23 nt, Human
gcacacaccuccgagacagucca

SEQ ID NO: 134870 - RNA, 22 nt, Human
gcuaggacuacaagugugugcc

SEQ ID NO: 134871 - RNA, 23 nt, Human
aacugauuugugauugaaagcug

SEQ ID NO: 134872 - RNA, 19 nt, Human
accaaaacaugucuuucuu

SEQ ID NO: 134873 - RNA, 25 nt, Human
uccuuucucccccuaaacuuuggcc

SEQ ID NO: 134874 - RNA, 18 nt, Human
ggguaauagcaauguguu

SEQ ID NO: 134875 - RNA, 21 nt, Human
ggggcacagacccacaguucc

SEQ ID NO: 134876 - RNA, 22 nt, Human
auuccuuuggaaaauucacugu

SEQ ID NO: 134877 - RNA, 22 nt, Human
ugaguguaggacacugagccau

SEQ ID NO: 134878 - RNA, 19 nt, Human
gauuacaggcgugagccac

SEQ ID NO: 134879 - RNA, 21 nt, Human
ugucuauauuggaacuagggu

SEQ ID NO: 134880 - RNA, 24 nt, Human
ccacccacacagcaccuccuccug

SEQ ID NO: 134881 - RNA, 23 nt, Human
uucgugccuccgagaaagggguc

SEQ ID NO: 134882 - RNA, 19 nt, Human
gcuuuugcgcacagcugcc

SEQ ID NO: 134883 - RNA, 26 nt, Human
aggauaagccucuuuauacucacuua

SEQ ID NO: 134884 - RNA, 23 nt, Human
aaacugcacuaugauuugcuuua

SEQ ID NO: 134885 - RNA, 23 nt, Human
agcugcccuccugaacacucccu

SEQ ID NO: 134886 - RNA, 19 nt, Human
uuccauuugcuaucauguc

SEQ ID NO: 134887 - RNA, 20 nt, Human
cucugcagucaugagcucug

SEQ ID NO: 134888 - RNA, 28 nt, Human
ccacgguggcuccagccaggaccagcca

SEQ ID NO: 134889 - RNA, 23 nt, Human
cacauccccaccuggcggagcuc

SEQ ID NO: 134890 - RNA, 26 nt, Human
cugggcuaucacauuauaaugcucuu

SEQ ID NO: 134891 - RNA, 26 nt, Human
guguucuaagcaaugcaaaugucuaa

SEQ ID NO: 134892 - RNA, 27 nt, Human
ccucugccucuuggguuucagugauuu

SEQ ID NO: 134893 - RNA, 22 nt, Human
ggggguuccuagacggagccag

SEQ ID NO: 134894 - RNA, 21 nt, Human
ucccugcagccccucgcacua

SEQ ID NO: 134895 - RNA, 25 nt, Human
ccugucuuucucucuggccugcugc

SEQ ID NO: 134896 - RNA, 23 nt, Human
cacagagcagugauaacuaccug

SEQ ID NO: 134897 - RNA, 17 nt, Human
aaaaccaaauuagccag

SEQ ID NO: 134898 - RNA, 20 nt, Human
uccugccaugugccugcacu

SEQ ID NO: 134899 - RNA, 21 nt, Human
cagcucaggauauggggccaa

SEQ ID NO: 134900 - RNA, 21 nt, Human
gaggguguauauuuucugugc

SEQ ID NO: 134901 - RNA, 28 nt, Human
cucugauucagcuguggagugugguugg

SEQ ID NO: 134902 - RNA, 17 nt, Human
uuguaauaacauguuca

SEQ ID NO: 134903 - RNA, 24 nt, Human
cugccaccacuuggcuauuugcac

SEQ ID NO: 134904 - RNA, 24 nt, Human
accaugccagcacagcgccaugag

SEQ ID NO: 134905 - RNA, 26 nt, Human
agccucccucgcaaguagcugggauu

SEQ ID NO: 134906 - RNA, 25 nt, Human
uggucucaaaaaauugcuaaauauu

SEQ ID NO: 134907 - RNA, 20 nt, Human
cauuccugagugugugcaca

SEQ ID NO: 134908 - RNA, 22 nt, Human
ccuaguaauucuccuaucucag

SEQ ID NO: 134909 - RNA, 18 nt, Human
agcuaucgccucuugccu

SEQ ID NO: 134910 - RNA, 23 nt, Human
uggaauauuugaauaaugacaga

SEQ ID NO: 134911 - RNA, 19 nt, Human
cuccacccuaaacaccgcc

SEQ ID NO: 134912 - RNA, 27 nt, Human
gguaauuuggauagggugaagcuuuga

SEQ ID NO: 134913 - RNA, 21 nt, Human
acuugcaguagaacuguggau

SEQ ID NO: 134914 - RNA, 21 nt, Human
agcucacugcaacuuccgcau

SEQ ID NO: 134915 - RNA, 20 nt, Human
aaagccagcagagcaaagcg

SEQ ID NO: 134916 - RNA, 21 nt, Human
aaaaacccacaggugcugcug

SEQ ID NO: 134917 - RNA, 26 nt, Human
gugggaggggcaggagagaaaaccac

SEQ ID NO: 134918 - RNA, 21 nt, Human
gcucugagacacgccccaaca

SEQ ID NO: 134919 - RNA, 27 nt, Human
uugggauaccuggauucugguucugac

SEQ ID NO: 134920 - RNA, 19 nt, Human
ggcuuauuuauugcuuuau

SEQ ID NO: 134921 - RNA, 22 nt, Human
acccagacuggcgugcaguggc

SEQ ID NO: 134922 - RNA, 22 nt, Human
cugagaagaucgugaggcugca

SEQ ID NO: 134923 - RNA, 22 nt, Human
aggcugagguaggaugauggcu

SEQ ID NO: 134924 - RNA, 27 nt, Human
guggaggagcuggaggagaagggguua

SEQ ID NO: 134925 - RNA, 22 nt, Human
guucugcuuugacaaacugaca

SEQ ID NO: 134926 - RNA, 20 nt, Human
aucucuaggccccagcccca

SEQ ID NO: 134927 - RNA, 23 nt, Human
uaccauucuauuucccaagggaa

SEQ ID NO: 134928 - RNA, 22 nt, Human
ccaaaguggugggauuacaggu

SEQ ID NO: 134929 - RNA, 20 nt, Human
agcccaggcuggagugcagu

SEQ ID NO: 134930 - RNA, 21 nt, Human
gcauuuuuaugucaccaacca

SEQ ID NO: 134931 - RNA, 22 nt, Human
uccagagucaucucagcccugc

SEQ ID NO: 134932 - RNA, 27 nt, Human
aaaaugcugagguaauaauuauaguau

SEQ ID NO: 134933 - RNA, 20 nt, Human
guauaguuuuauuuacuucu

SEQ ID NO: 134934 - RNA, 23 nt, Human
uucguuaucuucugauccuugca

SEQ ID NO: 134935 - RNA, 21 nt, Human
uuuacagugggggcaccaaga

SEQ ID NO: 134936 - RNA, 24 nt, Human
aaggugaugcagaaacuucuuucc

SEQ ID NO: 134937 - RNA, 27 nt, Human
cuucccaagccugagccaagcucaucu

SEQ ID NO: 134938 - RNA, 21 nt, Human
ccugccugccugccugccuga

SEQ ID NO: 134939 - RNA, 25 nt, Human
agccaguaccagcuuugguaauguu

SEQ ID NO: 134940 - RNA, 22 nt, Human
caaagagauaaacuacauaggg

SEQ ID NO: 134941 - RNA, 24 nt, Human
cccgccgcaggaaggagcaguccc

SEQ ID NO: 134942 - RNA, 24 nt, Human
agagcugcacuaucacgagccuuu

SEQ ID NO: 134943 - RNA, 27 nt, Human
guccuugucuccuugacauagugcugg

SEQ ID NO: 134944 - RNA, 22 nt, Human
ucucacaccauuuugcugguac

SEQ ID NO: 134945 - RNA, 27 nt, Human
gaggggaagaauuuaauggacugugaa

SEQ ID NO: 134946 - RNA, 20 nt, Human
ucagcauuuguuuaaauuuu

SEQ ID NO: 134947 - RNA, 25 nt, Human
ucccauuauaauagcauuauuugga

SEQ ID NO: 134948 - RNA, 17 nt, Human
uuuggagcuauucagga

SEQ ID NO: 134949 - RNA, 26 nt, Human
gagaagccagacuuccacuguggaag

SEQ ID NO: 134950 - RNA, 32 nt, Human
cuggccuccagaacucagccuccuggccgggg

SEQ ID NO: 134951 - RNA, 21 nt, Human
ucaacaaaauaaugcacuucc

SEQ ID NO: 134952 - RNA, 27 nt, Human
gggcuguaauuggccccagcugagcag

SEQ ID NO: 134953 - RNA, 25 nt, Human
gcugccggcaccgcccuccugcugc

SEQ ID NO: 134954 - RNA, 22 nt, Human
ugagcuucaaaaugagauaugc

SEQ ID NO: 134955 - RNA, 22 nt, Human
aagaaaaauauuucaaauagaa

SEQ ID NO: 134956 - RNA, 21 nt, Human
ccuguaaucccgacacuuugg

SEQ ID NO: 134957 - RNA, 30 nt, Human
ggccuccuuguccuggauuuccagcucucc

SEQ ID NO: 134958 - RNA, 22 nt, Human
cuuuuaaccugauuuucuuugu

SEQ ID NO: 134959 - RNA, 20 nt, Human
uauuagauuuuuaaggccua

SEQ ID NO: 134960 - RNA, 22 nt, Human
auugcuugaaccugugaggaag

SEQ ID NO: 134961 - RNA, 26 nt, Human
gcccuuccucccuugcacugcgcccc

SEQ ID NO: 134962 - RNA, 17 nt, Human
agggacgguucacaagg

SEQ ID NO: 134963 - RNA, 22 nt, Human
cugucacaaaaagccaggucuu

SEQ ID NO: 134964 - RNA, 20 nt, Human
ugaagcucucacacgcacag

SEQ ID NO: 134965 - RNA, 20 nt, Human
gugucaggcugggguuagug

SEQ ID NO: 134966 - RNA, 22 nt, Human
agccucccaaagugcagggauu

SEQ ID NO: 134967 - RNA, 22 nt, Human
uaaucaggacccaagucugcuu

SEQ ID NO: 134968 - RNA, 27 nt, Human
uuuuaauacaauuacugcccuaaaaug

SEQ ID NO: 134969 - RNA, 21 nt, Human
aaaaucaaauaagcuaauaaa

SEQ ID NO: 134970 - RNA, 22 nt, Human
uagagcauaccaguacucagua

SEQ ID NO: 134971 - RNA, 23 nt, Human
gucuuaguuccgcccuccugucc

SEQ ID NO: 134972 - RNA, 20 nt, Human
gacuggacauuuaacuuuuc

SEQ ID NO: 134973 - RNA, 27 nt, Human
uagauauaaugaacaaaauuauuugua

SEQ ID NO: 134974 - RNA, 23 nt, Human
ccucacagccucuugcugcuaaa

SEQ ID NO: 134975 - RNA, 22 nt, Human
auaaguuuuuaugugaggacuu

SEQ ID NO: 134976 - RNA, 26 nt, Human
cagaggguccucagagcaggagugac

SEQ ID NO: 134977 - RNA, 22 nt, Human
cagauguuugcacaguaucuua

SEQ ID NO: 134978 - RNA, 22 nt, Human
ggacugcgggcaagggagccgg

SEQ ID NO: 134979 - RNA, 21 nt, Human
aauggugcaaccacugaggca

SEQ ID NO: 134980 - RNA, 22 nt, Human
augagguggagccugaugauga

SEQ ID NO: 134981 - RNA, 23 nt, Human
ggcaggcggaggcgcgguccggg

SEQ ID NO: 134982 - RNA, 21 nt, Human
ggcugggggaaggagugugug

SEQ ID NO: 134983 - RNA, 20 nt, Human
aaaccaagcucagcugcauc

SEQ ID NO: 134984 - RNA, 28 nt, Human
gugacuauccuucuucacuuaggaagag

SEQ ID NO: 134985 - RNA, 27 nt, Human
gguggugaggagucuaagugggcucag

SEQ ID NO: 134986 - RNA, 22 nt, Human
aaaguauugggauuacccgcgu

SEQ ID NO: 134987 - RNA, 19 nt, Human
uggagcaugggcagaggag

SEQ ID NO: 134988 - RNA, 31 nt, Human
aggaugcauguuuauuugaggggauguggca

SEQ ID NO: 134989 - RNA, 22 nt, Human
aucuuccaaguacucagcuuuu

SEQ ID NO: 134990 - RNA, 26 nt, Human
gcgaggcagagccucuccucaaagcc

SEQ ID NO: 134991 - RNA, 21 nt, Human
gucuuaaaaauacucagcuuu

SEQ ID NO: 134992 - RNA, 23 nt, Human
uuccaucucagccucggagggca

SEQ ID NO: 134993 - RNA, 21 nt, Human
agacgagugcgguaacaccgu

SEQ ID NO: 134994 - RNA, 19 nt, Human
uacgacccaggacaauuag

SEQ ID NO: 134995 - RNA, 20 nt, Human
aucaggagugaacccagagg

SEQ ID NO: 134996 - RNA, 22 nt, Human
cccaaguagcugggauuacagg

SEQ ID NO: 134997 - RNA, 26 nt, Human
acuacugcuuagcuaauacuagguag

SEQ ID NO: 134998 - RNA, 20 nt, Human
caccagcagcaaaacaaaua

SEQ ID NO: 134999 - RNA, 16 nt, Human
agcuucuugcuccugu

SEQ ID NO: 135000 - RNA, 21 nt, Human
caggucuaccucugucacccg

SEQ ID NO: 135001 - RNA, 21 nt, Human
gcccuaaugugccauucccua

SEQ ID NO: 135002 - RNA, 24 nt, Human
uccaaugcaacaggaagcuaguga

SEQ ID NO: 135003 - RNA, 24 nt, Human
cugcccccugcguuccuccaucca

SEQ ID NO: 135004 - RNA, 24 nt, Human
ccugccgcccugccgcccugccgc

SEQ ID NO: 135005 - RNA, 22 nt, Human
accagccugggcaacaggguaa

SEQ ID NO: 135006 - RNA, 20 nt, Human
ugaugccaagcaucaaguca

SEQ ID NO: 135007 - RNA, 26 nt, Human
uugagauggagucucgcucugucacc

SEQ ID NO: 135008 - RNA, 26 nt, Human
uugagacagagucuugcucugucgcc

SEQ ID NO: 135009 - RNA, 26 nt, Human
uugagacggagucuugcucugucacc

SEQ ID NO: 135010 - RNA, 25 nt, Human
cacugacuucaugacagucuggccc

SEQ ID NO: 135011 - RNA, 26 nt, Human
gacuccugcugguaccugcccucuau

SEQ ID NO: 135012 - RNA, 24 nt, Human
cugccccccaaccucucuauggca

SEQ ID NO: 135013 - RNA, 21 nt, Human
aaauguucuuucaaaucucua

SEQ ID NO: 135014 - RNA, 23 nt, Human
caagccucuuucaucggggcaca

SEQ ID NO: 135015 - RNA, 22 nt, Human
uccugccugaccaccauccugc

SEQ ID NO: 135016 - RNA, 23 nt, Human
uacgccuguaaucccagugacuu

SEQ ID NO: 135017 - RNA, 22 nt, Human
uucaaguucacuuugcaagaga

SEQ ID NO: 135018 - RNA, 21 nt, Human
uuacuuugucucuuggagauu

SEQ ID NO: 135019 - RNA, 26 nt, Human
ggaccucggaccagagccauguaaga

SEQ ID NO: 135020 - RNA, 23 nt, Human
uaccaguuuuggagacugccuga

SEQ ID NO: 135021 - RNA, 22 nt, Human
cgucugguuaguggggacccaa

SEQ ID NO: 135022 - RNA, 30 nt, Human
guuggacuuccaggcugaaggggagaaagu

SEQ ID NO: 135023 - RNA, 23 nt, Human
gccccuuccugccugccuuccca

SEQ ID NO: 135024 - RNA, 20 nt, Human
ugugagccaggaaagggcug

SEQ ID NO: 135025 - RNA, 25 nt, Human
guggcccuuuaaaaggcagcuuauu

SEQ ID NO: 135026 - RNA, 21 nt, Human
agagaaaacugaagccuccca

SEQ ID NO: 135027 - RNA, 27 nt, Human
cgggaggcggagguugcgacccaaagc

SEQ ID NO: 135028 - RNA, 21 nt, Human
acaggcaagacuugcuucagc

SEQ ID NO: 135029 - RNA, 22 nt, Human
gucugccaggggcuucccacuu

SEQ ID NO: 135030 - RNA, 22 nt, Human
uguuuucauuuacaggaaauug

SEQ ID NO: 135031 - RNA, 26 nt, Human
gcucucaagcucuguucuucaucgca

SEQ ID NO: 135032 - RNA, 24 nt, Human
ggacccagcaggugaggcucggcu

SEQ ID NO: 135033 - RNA, 27 nt, Human
ccaggaggagaguguggaguccagagu

SEQ ID NO: 135034 - RNA, 24 nt, Human
agaguuacuaaggccuucagugaa

SEQ ID NO: 135035 - RNA, 24 nt, Human
uuuaggauauuguguugcacuaga

SEQ ID NO: 135036 - RNA, 26 nt, Human
gggaggcccgggcccugcccagcuac

SEQ ID NO: 135037 - RNA, 26 nt, Human
guuuucucaggauggauuuuugcugu

SEQ ID NO: 135038 - RNA, 21 nt, Human
augagacaaagacuguaacug

SEQ ID NO: 135039 - RNA, 17 nt, Human
cuucccuuauuugggac

SEQ ID NO: 135040 - RNA, 20 nt, Human
uuuuugagcccuuguuucag

SEQ ID NO: 135041 - RNA, 22 nt, Human
cccagcccugcccagcccugcc

SEQ ID NO: 135042 - RNA, 23 nt, Human
gagggacguguggggacaggugc

SEQ ID NO: 135043 - RNA, 25 nt, Human
uuuugaaauauucacaagguugcug

SEQ ID NO: 135044 - RNA, 22 nt, Human
uggucugaauuuauccaggcag

SEQ ID NO: 135045 - RNA, 21 nt, Human
cucaggaggcugaggugggag

SEQ ID NO: 135046 - RNA, 24 nt, Human
ugcacucuuaaacagcaccaccau

SEQ ID NO: 135047 - RNA, 29 nt, Human
augcuaucauagcacacuacagccuccaa

SEQ ID NO: 135048 - RNA, 19 nt, Human
gggauuuuauuucagugaa

SEQ ID NO: 135049 - RNA, 27 nt, Human
cccaaguaguuaggacacacaggugug

SEQ ID NO: 135050 - RNA, 27 nt, Human
ggacuccuguuuacuucuagaccuggu

SEQ ID NO: 135051 - RNA, 26 nt, Human
ccuccaggagccuacccccugaaaau

SEQ ID NO: 135052 - RNA, 20 nt, Human
ccaucuccuuucagaaaaau

SEQ ID NO: 135053 - RNA, 21 nt, Human
uaauuugccauuuuuauuaga

SEQ ID NO: 135054 - RNA, 22 nt, Human
caaccauggacuuuauaagcca

SEQ ID NO: 135055 - RNA, 20 nt, Human
uauuuaguucucagcucuuc

SEQ ID NO: 135056 - RNA, 24 nt, Human
acuguucuucagcaacuauuguac

SEQ ID NO: 135057 - RNA, 26 nt, Human
ucuccaggaacgcugcagggaaaacc

SEQ ID NO: 135058 - RNA, 26 nt, Human
ccuggguggaaagcgguuuggaugaa

SEQ ID NO: 135059 - RNA, 27 nt, Human
gccugcaggaagaucuggcucagucua

SEQ ID NO: 135060 - RNA, 19 nt, Human
acggggcggguggggaggg

SEQ ID NO: 135061 - RNA, 27 nt, Human
ugucugugucccagccacgcagggcca

SEQ ID NO: 135062 - RNA, 19 nt, Human
aucgccacuacagccuggg

SEQ ID NO: 135063 - RNA, 22 nt, Human
cacugcaccggagugagcgcga

SEQ ID NO: 135064 - RNA, 21 nt, Human
guugcccaugagaaguguccu

SEQ ID NO: 135065 - RNA, 23 nt, Human
accugcugcaagucacugccuuc

SEQ ID NO: 135066 - RNA, 27 nt, Human
uagcucuucgcagagcaaccaggagcc

SEQ ID NO: 135067 - RNA, 27 nt, Human
gcuacccugaucagagucaucaugccu

SEQ ID NO: 135068 - RNA, 21 nt, Human
acagcgccucaccgccaccag

SEQ ID NO: 135069 - RNA, 25 nt, Human
cucucugaaacucaggcugaggcag

SEQ ID NO: 135070 - RNA, 25 nt, Human
uucugcuucuucuagagauggugcu

SEQ ID NO: 135071 - RNA, 23 nt, Human
guuucuggcgccccugccugugc

SEQ ID NO: 135072 - RNA, 28 nt, Human
gggaccuucgcgacacaccagauccucg

SEQ ID NO: 135073 - RNA, 18 nt, Human
aguacacuggcaucaucu

SEQ ID NO: 135074 - RNA, 23 nt, Human
cccgggcauccugcccgccgccu

SEQ ID NO: 135075 - RNA, 25 nt, Human
agcucuuucucggcuuucuauuucc

SEQ ID NO: 135076 - RNA, 19 nt, Human
aauaguuacaguugggcau

SEQ ID NO: 135077 - RNA, 21 nt, Human
cccgcugaacaucagccuggg

SEQ ID NO: 135078 - RNA, 21 nt, Human
gccccuccacgccuccuggcc

SEQ ID NO: 135079 - RNA, 24 nt, Human
uucccucugcugaugauggaugcc

SEQ ID NO: 135080 - RNA, 26 nt, Human
ugcucaggcugggaggguagaaugcc

SEQ ID NO: 135081 - RNA, 19 nt, Human
ugggagccggcgggagguc

SEQ ID NO: 135082 - RNA, 20 nt, Human
cugcagcuucuacuugagcc

SEQ ID NO: 135083 - RNA, 25 nt, Human
cugcccaggugggguuuccugcaug

SEQ ID NO: 135084 - RNA, 17 nt, Human
cucagcaacaacacuua

SEQ ID NO: 135085 - RNA, 25 nt, Human
cgcugcggggccuguggagaguggg

SEQ ID NO: 135086 - RNA, 23 nt, Human
caggaauauuuuccaaagaguga

SEQ ID NO: 135087 - RNA, 16 nt, Human
gcguaugacacauuga

SEQ ID NO: 135088 - RNA, 25 nt, Human
gucucgaauuccuggacucaagcag

SEQ ID NO: 135089 - RNA, 16 nt, Human
uggacaucacagcaga

SEQ ID NO: 135090 - RNA, 22 nt, Human
accucugcuuucugauguugcc

SEQ ID NO: 135091 - RNA, 21 nt, Human
cugucuuccuuccuccucaua

SEQ ID NO: 135092 - RNA, 22 nt, Human
uacugcacugggcacuggggag

SEQ ID NO: 135093 - RNA, 26 nt, Human
cuuaaaacaugcacauauaccagguu

SEQ ID NO: 135094 - RNA, 22 nt, Human
ccuuccuaauuuaaaaagacaa

SEQ ID NO: 135095 - RNA, 19 nt, Human
uggaauuacuauguggaaa

SEQ ID NO: 135096 - RNA, 27 nt, Human
cccugcuccuccucuucccuuuggggc

SEQ ID NO: 135097 - RNA, 22 nt, Human
ccauccaucccaccugccacua

SEQ ID NO: 135098 - RNA, 19 nt, Human
ucccugucgucgcacuuug

SEQ ID NO: 135099 - RNA, 22 nt, Human
uuccuccaaggcuggagugcag

SEQ ID NO: 135100 - RNA, 22 nt, Human
uggcucacgccuguaauccugg

SEQ ID NO: 135101 - RNA, 20 nt, Human
aucgguuccaaacagcaguu

SEQ ID NO: 135102 - RNA, 23 nt, Human
uuaagacgacggaggcggggcaa

SEQ ID NO: 135103 - RNA, 22 nt, Human
ccuggguugucgcggcagcagu

SEQ ID NO: 135104 - RNA, 24 nt, Human
ggggugaggagccugcggugcucc

SEQ ID NO: 135105 - RNA, 22 nt, Human
agccucccaaagugcugagauu

SEQ ID NO: 135106 - RNA, 22 nt, Human
agccucccagagugcugggauu

SEQ ID NO: 135107 - RNA, 24 nt, Human
gcccaaaccuaggcauuuaaugca

SEQ ID NO: 135108 - RNA, 22 nt, Human
gcgcccaccaccaugcccggcu

SEQ ID NO: 135109 - RNA, 21 nt, Human
aucuugaacuccugaccucag

SEQ ID NO: 135110 - RNA, 27 nt, Human
cauggacaaauaggcucugccaucagg

SEQ ID NO: 135111 - RNA, 20 nt, Human
ccacugcacuccagccugag

SEQ ID NO: 135112 - RNA, 22 nt, Human
ggggaaugucaacaggcagggg

SEQ ID NO: 135113 - RNA, 20 nt, Human
gaugcauggagauagcccca

SEQ ID NO: 135114 - RNA, 21 nt, Human
uugcccaggcuggucucgaac

SEQ ID NO: 135115 - RNA, 25 nt, Human
ugguuuauaauccuugaauauuguu

SEQ ID NO: 135116 - RNA, 21 nt, Human
gucugauuuucuccaucaucc

SEQ ID NO: 135117 - RNA, 21 nt, Human
auuguucugcucauuguguuu

SEQ ID NO: 135118 - RNA, 26 nt, Human
cucccaucuucucauauccuggcucu

SEQ ID NO: 135119 - RNA, 32 nt, Human
cccgcaggcuucguuugccuccagaaccuucc

SEQ ID NO: 135120 - RNA, 20 nt, Human
cuguucuuuaaaugcguucc

SEQ ID NO: 135121 - RNA, 25 nt, Human
cuccuugcauggcuugugugguccu

SEQ ID NO: 135122 - RNA, 18 nt, Human
cugggugugcagggaggg

SEQ ID NO: 135123 - RNA, 21 nt, Human
ugcacucguuugcuuucucca

SEQ ID NO: 135124 - RNA, 26 nt, Human
uuggcccagcgccaaguaaacagggu

SEQ ID NO: 135125 - RNA, 22 nt, Human
ccuuccucucugugccgugcuu

SEQ ID NO: 135126 - RNA, 22 nt, Human
agcuugguggagcgucugcacc

SEQ ID NO: 135127 - RNA, 20 nt, Human
cuaguaacagcaggccuuuu

SEQ ID NO: 135128 - RNA, 27 nt, Human
uccaaacagagcaacaacaaguacgcg

SEQ ID NO: 135129 - RNA, 20 nt, Human
caccaguccccagcugcaga

SEQ ID NO: 135130 - RNA, 21 nt, Human
aggggagggggaaaggauagu

SEQ ID NO: 135131 - RNA, 22 nt, Human
agggagcuccuggcaguagcac

SEQ ID NO: 135132 - RNA, 21 nt, Human
auauggagcaccauucuuuaa

SEQ ID NO: 135133 - RNA, 27 nt, Human
gggaaagggaaaaaacagaauuguaac

SEQ ID NO: 135134 - RNA, 26 nt, Human
ccaggugcuuuccagacuccaaaggg

SEQ ID NO: 135135 - RNA, 26 nt, Human
aagaauuggccuggcugggugcagug

SEQ ID NO: 135136 - RNA, 21 nt, Human
ucauuuuaaagccaaucaguc

SEQ ID NO: 135137 - RNA, 22 nt, Human
ugggaggcggagguugcagcga

SEQ ID NO: 135138 - RNA, 13 nt, Human
accaaaugccugc

SEQ ID NO: 135139 - RNA, 20 nt, Human
ucuuuacuuuugucuuuggg

SEQ ID NO: 135140 - RNA, 21 nt, Human
uccuccagggccucugguuug

SEQ ID NO: 135141 - RNA, 21 nt, Human
aucuucaauauuaauauugug

SEQ ID NO: 135142 - RNA, 19 nt, Human
acaaaacaaaacacagcuu

SEQ ID NO: 135143 - RNA, 27 nt, Human
uugcccaggcuggagugcaguggugug

SEQ ID NO: 135144 - RNA, 22 nt, Human
ccugaauggcuuugucuugaaa

SEQ ID NO: 135145 - RNA, 22 nt, Human
cgacagagggagacuccaucuc

SEQ ID NO: 135146 - RNA, 21 nt, Human
gcuccuguuuccgcugcucug

SEQ ID NO: 135147 - RNA, 27 nt, Human
ggcaaaguccaucggguccugggccuc

SEQ ID NO: 135148 - RNA, 24 nt, Human
cucauuucuccuauaaccaccgca

SEQ ID NO: 135149 - RNA, 27 nt, Human
aaauguccaauauggagaacagcuuug

SEQ ID NO: 135150 - RNA, 21 nt, Human
aauuuuaaaaaagccuuccua

SEQ ID NO: 135151 - RNA, 20 nt, Human
caugcacacagaccacauag

SEQ ID NO: 135152 - RNA, 25 nt, Human
acuggaaaagggaaggugacugaag

SEQ ID NO: 135153 - RNA, 22 nt, Human
gcccacaagcugcaucaggguc

SEQ ID NO: 135154 - RNA, 18 nt, Human
cugcuccagucagccugc

SEQ ID NO: 135155 - RNA, 30 nt, Human
ccaucuguaaagucuccucuggaaaugcca

SEQ ID NO: 135156 - RNA, 24 nt, Human
gggcuggagugugaggguccugca

SEQ ID NO: 135157 - RNA, 24 nt, Human
guuaggggacacugaacugcuuuu

SEQ ID NO: 135158 - RNA, 25 nt, Human
uucccagacacuuguuaucuuguuc

SEQ ID NO: 135159 - RNA, 23 nt, Human
ccuuccuuccuguuucuucccac

SEQ ID NO: 135160 - RNA, 21 nt, Human
cuaucggccaggcuggagugc

SEQ ID NO: 135161 - RNA, 27 nt, Human
cugccucuaguccccaaggccucucuc

SEQ ID NO: 135162 - RNA, 21 nt, Human
ggaggcugagguggcugcagg

SEQ ID NO: 135163 - RNA, 26 nt, Human
gcaucaucucccuccugcgaggagcu

SEQ ID NO: 135164 - RNA, 27 nt, Human
ugcauuuccuccugccuuugcuuguuc

SEQ ID NO: 135165 - RNA, 27 nt, Human
acuguaaccucaaacuccuggacucau

SEQ ID NO: 135166 - RNA, 22 nt, Human
uuccuuuuuccuuucuuucuug

SEQ ID NO: 135167 - RNA, 24 nt, Human
gcugggucccagccugguuugcaa

SEQ ID NO: 135168 - RNA, 20 nt, Human
ugauggccaggguggggugu

SEQ ID NO: 135169 - RNA, 22 nt, Human
gacauaacagacuuggaagcag

SEQ ID NO: 135170 - RNA, 27 nt, Human
ccauuuggauuaguagccuuagcaaug

SEQ ID NO: 135171 - RNA, 25 nt, Human
accaaaacagcauguguaagaggca

SEQ ID NO: 135172 - RNA, 21 nt, Human
ccacccaggcuggaguacagu

SEQ ID NO: 135173 - RNA, 22 nt, Human
cucagccucccaaguagcuagg

SEQ ID NO: 135174 - RNA, 29 nt, Human
ugguggaggcuggccucucuggcugggug

SEQ ID NO: 135175 - RNA, 22 nt, Human
cugaugcuuccugagggccaag

SEQ ID NO: 135176 - RNA, 21 nt, Human
cagcacuggauuccuggucgg

SEQ ID NO: 135177 - RNA, 21 nt, Human
auguucuuuaguuugcugcua

SEQ ID NO: 135178 - RNA, 23 nt, Human
aacaacaaaaugugcucuacucu

SEQ ID NO: 135179 - RNA, 22 nt, Human
ccccugaaccuccagccagggg

SEQ ID NO: 135180 - RNA, 24 nt, Human
ggcagguuacagaguucugggauu

SEQ ID NO: 135181 - RNA, 20 nt, Human
caagaaauggccuguggaau

SEQ ID NO: 135182 - RNA, 27 nt, Human
cagccauccaauucuugaguuuucuca

SEQ ID NO: 135183 - RNA, 22 nt, Human
cgcucccuguagcucugccucc

SEQ ID NO: 135184 - RNA, 21 nt, Human
ggcugacugcaaccacugccu

SEQ ID NO: 135185 - RNA, 22 nt, Human
gacaguauuucagaaaaggaga

SEQ ID NO: 135186 - RNA, 21 nt, Human
agccacccuccuccacagguc

SEQ ID NO: 135187 - RNA, 23 nt, Human
ccuccuccuccuccacuugcagc

SEQ ID NO: 135188 - RNA, 23 nt, Human
ccggcuccuguucgaccgcccga

SEQ ID NO: 135189 - RNA, 25 nt, Human
cgcugccuucacugaaggcugcagu

SEQ ID NO: 135190 - RNA, 27 nt, Human
ucucaacugcgcaagcugcuugcccau

SEQ ID NO: 135191 - RNA, 23 nt, Human
auguucaggcuggggcugcuggu

SEQ ID NO: 135192 - RNA, 31 nt, Human; identical to SEQ ID NO: 5009

SEQ ID NO: 135193 - RNA, 26 nt, Human
gucucaaacuccugaccucaagugau

SEQ ID NO: 135194 - RNA, 21 nt, Human
gggguuucagccccacccuca

SEQ ID NO: 135195 - RNA, 22 nt, Human
ccuguggccuucagggcucaga

SEQ ID NO: 135196 - RNA, 23 nt, Human
ggccccggagcccggucgcagga

SEQ ID NO: 135197 - RNA, 27 nt, Human
ggcugggugggagcggggagggacuag

SEQ ID NO: 135198 - RNA, 20 nt, Human
agacacagcagaaagggggc

SEQ ID NO: 135199 - RNA, 20 nt, Human
uugcuuuggucuaucuuuga

SEQ ID NO: 135200 - RNA, 23 nt, Human
aggcuggagugccguggcacgau

SEQ ID NO: 135201 - RNA, 26 nt, Human
gucacacauggaggcuggacagcugc

SEQ ID NO: 135202 - RNA, 26 nt, Human
ccuuucucccucacucagggcaccug

SEQ ID NO: 135203 - RNA, 27 nt, Human
gagagccgaggugggaggcaugggaaa

SEQ ID NO: 135204 - RNA, 24 nt, Human
uccaguuaugcagaagaaauucau

SEQ ID NO: 135205 - RNA, 21 nt, Human
caaggcugggaaaagacaaug

SEQ ID NO: 135206 - RNA, 22 nt, Human
cccgcagaguccucccugcugc

SEQ ID NO: 135207 - RNA, 20 nt, Human
agaccugaaucacagcagug

SEQ ID NO: 135208 - RNA, 27 nt, Human
gaccccuggcuuuucacugcuggcugc

SEQ ID NO: 135209 - RNA, 20 nt, Human
ggcagguuccccugcccuga

SEQ ID NO: 135210 - RNA, 22 nt, Human
aaauagauugacaucagccuga

SEQ ID NO: 135211 - RNA, 21 nt, Human
cagcgacucaccaguugccuc

SEQ ID NO: 135212 - RNA, 20 nt, Human
gcuagcaccuagcauuucag

SEQ ID NO: 135213 - RNA, 22 nt, Human
uguaagcuaaaaagcuguguga

SEQ ID NO: 135214 - RNA, 21 nt, Human
ugucuccaggcugugugcuca

SEQ ID NO: 135215 - RNA, 26 nt, Human
aagcuguuugcuauaguuuccaaggu

SEQ ID NO: 135216 - RNA, 25 nt, Human
cccuccugauuguagauuuccuaau

SEQ ID NO: 135217 - RNA, 24 nt, Human
cuucagaaaguagaggaacuaggg

SEQ ID NO: 135218 - RNA, 24 nt, Human
ggauacugauuugaacaauguaga

SEQ ID NO: 135219 - RNA, 24 nt, Human
agccacagugaugcaugcuuuucg

SEQ ID NO: 135220 - RNA, 23 nt, Human
uugggacgauagugcagcuuugg

SEQ ID NO: 135221 - RNA, 27 nt, Human
ccacugcacuccagccugggcaacgga

SEQ ID NO: 135222 - RNA, 19 nt, Human
ccacacuagccucuguguu

SEQ ID NO: 135223 - RNA, 29 nt, Human
cugccuagcucuugggccugaccuccagu

SEQ ID NO: 135224 - RNA, 22 nt, Human
gggauuacagguguaagccacu

SEQ ID NO: 135225 - RNA, 29 nt, Human
ugccuggaucucacgagcacuuucccucu

SEQ ID NO: 135226 - RNA, 27 nt, Human
uaagggagagucaaugggcagagccag

SEQ ID NO: 135227 - RNA, 23 nt, Human
gcuucuuccuuaaagcauuugca

SEQ ID NO: 135228 - RNA, 27 nt, Human
gcuuguaguucuuuaaacugucguguc

SEQ ID NO: 135229 - RNA, 27 nt, Human
uucauuucuccuguccccuccccuccc

SEQ ID NO: 135230 - RNA, 23 nt, Human
aucugaaauuguauuaucuauuu

SEQ ID NO: 135231 - RNA, 22 nt, Human
aaccugggaggugcugaagggg

SEQ ID NO: 135232 - RNA, 21 nt, Human
acacauuugcgccaaaaguau

SEQ ID NO: 135233 - RNA, 23 nt, Human
uggggcuggagagaugggcauaa

SEQ ID NO: 135234 - RNA, 21 nt, Human
ugggcagcccgcuaggcucgc

SEQ ID NO: 135235 - RNA, 21 nt, Human
augggcagguggccucugcug

SEQ ID NO: 135236 - RNA, 21 nt, Human
ggcaggcgagaguaguacugg

SEQ ID NO: 135237 - RNA, 22 nt, Human
uugacgcagccccuacacucca

SEQ ID NO: 135238 - RNA, 20 nt, Human
guuuccauuaaucuuuuucu

SEQ ID NO: 135239 - RNA, 22 nt, Human
cauucuccauccuuccuuauca

SEQ ID NO: 135240 - RNA, 19 nt, Human
agcauuuucaccgcccugg

SEQ ID NO: 135241 - RNA, 32 nt, Human
ggaggugaggagcagagcaggcaauuucacca

SEQ ID NO: 135242 - RNA, 27 nt, Human
ccaggaggagaguguggaguccagagc

SEQ ID NO: 135243 - RNA, 26 nt, Human
agaaucaagaucuucccucucugagc

SEQ ID NO: 135244 - RNA, 25 nt, Human
cgugccggccgcauccuugcacgcc

SEQ ID NO: 135245 - RNA, 24 nt, Human
uccaaugaauaaaguucucuugac

SEQ ID NO: 135246 - RNA, 22 nt, Human
accuacuggggacugugcucac

SEQ ID NO: 135247 - RNA, 21 nt, Human
agcugcuguacuuuucacauu

SEQ ID NO: 135248 - RNA, 21 nt, Human
ggcuagcagggugguuccugc

SEQ ID NO: 135249 - RNA, 24 nt, Human
gcuguuucccuuccucuguccaua

SEQ ID NO: 135250 - RNA, 24 nt, Human
agggacgauggggugaagucagcu

SEQ ID NO: 135251 - RNA, 20 nt, Human
cagaaaggaagaaacuagcg

SEQ ID NO: 135252 - RNA, 22 nt, Human
acucagaugccucaucuugccu

SEQ ID NO: 135253 - RNA, 22 nt, Human
ccacuguacuccauccugggug

SEQ ID NO: 135254 - RNA, 24 nt, Human
gcugugagccacugugccaaggcu

SEQ ID NO: 135255 - RNA, 20 nt, Human
aggaggguaaaaauggaggc

SEQ ID NO: 135256 - RNA, 24 nt, Human
uccuccaggccucugguuuagcgg

SEQ ID NO: 135257 - RNA, 21 nt, Human
aggccuucacccucugcucug

SEQ ID NO: 135258 - RNA, 19 nt, Human
cagaccagcagagcaggga

SEQ ID NO: 135259 - RNA, 22 nt, Human
uuacuauauguaacuucagaca

SEQ ID NO: 135260 - RNA, 22 nt, Human
gcuguuuuugugccuguuugaa

SEQ ID NO: 135261 - RNA, 20 nt, Human
cuggugcaugcucaaguuug

SEQ ID NO: 135262 - RNA, 22 nt, Human
agaccagccugggcuacagagc

SEQ ID NO: 135263 - RNA, 21 nt, Human
cucucaggagccuucuccgca

SEQ ID NO: 135264 - RNA, 23 nt, Human
uuguaaacuauucauuuucucca

SEQ ID NO: 135265 - RNA, 19 nt, Human
acaauggauuuacagcucu

SEQ ID NO: 135266 - RNA, 20 nt, Human
ggcuuguuaaaaagcuuaaa

SEQ ID NO: 135267 - RNA, 23 nt, Human
ugcugcuaauuauaucagcucug

SEQ ID NO: 135268 - RNA, 27 nt, Human
ucacuagaaaugccuuuaacauucaua

SEQ ID NO: 135269 - RNA, 27 nt, Human
ggcuguggcugcugucauggcaccuca

SEQ ID NO: 135270 - RNA, 27 nt, Human
ucucuaauuccacuuguucauucugug

SEQ ID NO: 135271 - RNA, 27 nt, Human
ggcaguuucagggccccucccuaggcc

SEQ ID NO: 135272 - RNA, 21 nt, Human
gcugcaucggccugccugugu

SEQ ID NO: 135273 - RNA, 24 nt, Human
gcuuuuaaaaaauaucuggaacua

SEQ ID NO: 135274 - RNA, 24 nt, Human
cuaacauccuuguuuuagaauucu

SEQ ID NO: 135275 - RNA, 17 nt, Human
ggggaagagaaagcagg

SEQ ID NO: 135276 - RNA, 26 nt, Human
ccuguagucccagcacuuugagaggc

SEQ ID NO: 135277 - RNA, 21 nt, Human
cuucaaauauguccucaggcc

SEQ ID NO: 135278 - RNA, 25 nt, Human
caaagaugaaagcuguuucauuugu

SEQ ID NO: 135279 - RNA, 25 nt, Human
ugcuuucuccuuuacuuggaaggcu

SEQ ID NO: 135280 - RNA, 17 nt, Human
aguaaagcccuuccggg

SEQ ID NO: 135281 - RNA, 21 nt, Human
cauaugcaggacggcaguacu

SEQ ID NO: 135282 - RNA, 21 nt, Human
gcuggggucucagggcucaga

SEQ ID NO: 135283 - RNA, 25 nt, Human
cgccaugggaguggagggcugcacc

SEQ ID NO: 135284 - RNA, 20 nt, Human
ccucugcuccugagaugcug

SEQ ID NO: 135285 - RNA, 26 nt, Human
cccugccucugguggacagcaucguc

SEQ ID NO: 135286 - RNA, 23 nt, Human
uuuuggcugaagaaugcucugca

SEQ ID NO: 135287 - RNA, 22 nt, Human
cgcccccaacaacucugcuuuu

SEQ ID NO: 135288 - RNA, 19 nt, Human
guuuuuccaguuccaggac

SEQ ID NO: 135289 - RNA, 24 nt, Human
uggagagaagccgugguggugaaa

SEQ ID NO: 135290 - RNA, 27 nt, Human
cugccuaagccucucccuccagccaau

SEQ ID NO: 135291 - RNA, 21 nt, Human
gaugccgaugccggcuuggag

SEQ ID NO: 135292 - RNA, 24 nt, Human
ccaugaucauugcugaacucagag

SEQ ID NO: 135293 - RNA, 22 nt, Human
guucaucuugcugagagacuua

SEQ ID NO: 135294 - RNA, 21 nt, Human
ccggggcagggcagggcuggg

SEQ ID NO: 135295 - RNA, 21 nt, Human
uaagcagucccugagaccauu

SEQ ID NO: 135296 - RNA, 21 nt, Human
gggacaggcugggcagagggg

SEQ ID NO: 135297 - RNA, 22 nt, Human
cuaaggcaggagaaucacuuga

SEQ ID NO: 135298 - RNA, 17 nt, Human
accuuuaaaaugccuuc

SEQ ID NO: 135299 - RNA, 20 nt, Human
agguacacuaaagggaccug

SEQ ID NO: 135300 - RNA, 20 nt, Human
aagugcauuuaaauacaaac

SEQ ID NO: 135301 - RNA, 26 nt, Human
ugcccuccuccacucccuuuuuguaa

SEQ ID NO: 135302 - RNA, 21 nt, Human
aaaguuccuuaaaaugcucug

SEQ ID NO: 135303 - RNA, 22 nt, Human
uguauuucauguggcuguagau

SEQ ID NO: 135304 - RNA, 24 nt, Human
cucugugcccccagucuggaaucc

SEQ ID NO: 135305 - RNA, 25 nt, Human
gcuucacuucaacuucacuacuucu

SEQ ID NO: 135306 - RNA, 21 nt, Human
guuaccauuacaaaugggaua

SEQ ID NO: 135307 - RNA, 20 nt, Human
ugauuguuaucuuggugcug

SEQ ID NO: 135308 - RNA, 22 nt, Human
uuguaccccacccuguuccugu

SEQ ID NO: 135309 - RNA, 17 nt, Human
caguuucagaggccuua

SEQ ID NO: 135310 - RNA, 24 nt, Human
agacaggagaaucgcuuaaaccug

SEQ ID NO: 135311 - RNA, 23 nt, Human
ggggcagauggcgagggagcggg

SEQ ID NO: 135312 - RNA, 22 nt, Human
uuuaaaaaacccuauaguuugg

SEQ ID NO: 135313 - RNA, 26 nt, Human
uaacuugccaacagucucuaugcuua

SEQ ID NO: 135314 - RNA, 24 nt, Human
guaaucuagaaaguguuauguaag

SEQ ID NO: 135315 - RNA, 27 nt, Human
uggucucacagagccaacucacucuua

SEQ ID NO: 135316 - RNA, 20 nt, Human
ccuguaaucccagcacuggg

SEQ ID NO: 135317 - RNA, 22 nt, Human
ggggccaucaaaaacaggcuga

SEQ ID NO: 135318 - RNA, 24 nt, Human
ugguucaugccuucugcugggaca

SEQ ID NO: 135319 - RNA, 23 nt, Human
agucaauuccugauuauccacag

SEQ ID NO: 135320 - RNA, 22 nt, Human
aucaugguguuuauuuucuuuc

SEQ ID NO: 135321 - RNA, 19 nt, Human
gacuacaggugugcaccac

SEQ ID NO: 135322 - RNA, 23 nt, Human
gcacuggucuaggccagguauga

SEQ ID NO: 135323 - RNA, 25 nt, Human
cacuggguggagcuguggcaggggg

SEQ ID NO: 135324 - RNA, 23 nt, Human
accuacucuuccaggacucucug

SEQ ID NO: 135325 - RNA, 27 nt, Human
cucaguucuuccuccaccuccacccag

SEQ ID NO: 135326 - RNA, 20 nt, Human
uuuuaauuuucaucauucca

SEQ ID NO: 135327 - RNA, 24 nt, Human
cccgcugccgccacccaccucucc

SEQ ID NO: 135328 - RNA, 27 nt, Human
cucgggaggcugagacaggagaaucgc

SEQ ID NO: 135329 - RNA, 21 nt, Human
cuucccuuggcacaccagugu

SEQ ID NO: 135330 - RNA, 22 nt, Human
ggagcacagcucaggaacuaga

SEQ ID NO: 135331 - RNA, 24 nt, Human
auugccagcuucagggagcuggag

SEQ ID NO: 135332 - RNA, 22 nt, Human
cugaucuguguuagaaguguug

SEQ ID NO: 135333 - RNA, 21 nt, Human
cugcccugcgggcucaggcgg

SEQ ID NO: 135334 - RNA, 21 nt, Human
cagggcauccgcagcccaggg

SEQ ID NO: 135335 - RNA, 23 nt, Human
aucaugccacugcacuccggccu

SEQ ID NO: 135336 - RNA, 22 nt, Human
cccccugcccgcccaccucccu

SEQ ID NO: 135337 - RNA, 23 nt, Human
ggcucacugcaacuucugccucc

SEQ ID NO: 135338 - RNA, 23 nt, Human
gucucccaggcuggagugcaauc

SEQ ID NO: 135339 - RNA, 25 nt, Human
ggagagaaauucaggagcaccuagc

SEQ ID NO: 135340 - RNA, 23 nt, Human
ggggggaccuggaggcagagggg

SEQ ID NO: 135341 - RNA, 20 nt, Human
gugccuggcaaggccucugc

SEQ ID NO: 135342 - RNA, 23 nt, Human
uaagaacucuaacaaacacaagg

SEQ ID NO: 135343 - RNA, 25 nt, Human
ucaacuugcuuuauaaucuccugca

SEQ ID NO: 135344 - RNA, 24 nt, Human
cccuuccaaccccuucuucauagg

SEQ ID NO: 135345 - RNA, 27 nt, Human
gaggaugggguuucacuauguuggcca

SEQ ID NO: 135346 - RNA, 22 nt, Human
aaccuaauucaaacuggcuuaa

SEQ ID NO: 135347 - RNA, 22 nt, Human
ucaucccagccccaauuuucug

SEQ ID NO: 135348 - RNA, 21 nt, Human
auccacugccaauucagcucc

SEQ ID NO: 135349 - RNA, 23 nt, Human
ggaggaagggagggcagaggggg

SEQ ID NO: 135350 - RNA, 21 nt, Human
ccagcaggguauggccagcuu

SEQ ID NO: 135351 - RNA, 20 nt, Human
caacauagugagacugucuc

SEQ ID NO: 135352 - RNA, 21 nt, Human
ucacucaagaggaggggccgg

SEQ ID NO: 135353 - RNA, 22 nt, Human
uagaagggaagaaauugucccu

SEQ ID NO: 135354 - RNA, 22 nt, Human
ccucuugcuaacuuuuuauugg

SEQ ID NO: 135355 - RNA, 29 nt, Human
ucagguguggcagaagcuugcagaugcgu

SEQ ID NO: 135356 - RNA, 18 nt, Human
gguggaggaaggagcagg

SEQ ID NO: 135357 - RNA, 23 nt, Human
ccaaguauacuggugaaaucucg

SEQ ID NO: 135358 - RNA, 25 nt, Human
uuuugugcacucugcucuaaaacag

SEQ ID NO: 135359 - RNA, 27 nt, Human
ugccauaggguccugaauguuucagac

SEQ ID NO: 135360 - RNA, 27 nt, Human
uuucaccauuuucuccccacuuccagu

SEQ ID NO: 135361 - RNA, 20 nt, Human
ccagcugcucccagaagaac

SEQ ID NO: 135362 - RNA, 20 nt, Human
ugucuucaucagaaaacagu

SEQ ID NO: 135363 - RNA, 25 nt, Human
gccacuacaccuggcuaauuuuugu

SEQ ID NO: 135364 - RNA, 20 nt, Human
auucagucugugacugugga

SEQ ID NO: 135365 - RNA, 20 nt, Human
acaagugucuucacugugga

SEQ ID NO: 135366 - RNA, 26 nt, Human
uguuuuuccuugaacaacuuuggaaa

SEQ ID NO: 135367 - RNA, 22 nt, Human
uuugguaacuuuuaugccuuca

SEQ ID NO: 135368 - RNA, 23 nt, Human
caccauggacauguguacauuga

SEQ ID NO: 135369 - RNA, 22 nt, Human
cacacauaucaaaaaacaaaug

SEQ ID NO: 135370 - RNA, 27 nt, Human
gugugcaugacaacucguguguaugag

SEQ ID NO: 135371 - RNA, 20 nt, Human
gaaaacaaagacauucuucc

SEQ ID NO: 135372 - RNA, 19 nt, Human
uuccuuccccuccucucuc

SEQ ID NO: 135373 - RNA, 23 nt, Human
uccugcuuuuuuguuucaagggu

SEQ ID NO: 135374 - RNA, 22 nt, Human
cccugccugcugccucagucug

SEQ ID NO: 135375 - RNA, 19 nt, Human
uuaccugcacucguaccau

SEQ ID NO: 135376 - RNA, 28 nt, Human
uuacccugggcuggagaguugguuucag

SEQ ID NO: 135377 - RNA, 21 nt, Human
aggcucucuuucggccuccca

SEQ ID NO: 135378 - RNA, 24 nt, Human
cugcugcugcugcugcugcuucuc

SEQ ID NO: 135379 - RNA, 20 nt, Human
ggucaucucuguuuccagag

SEQ ID NO: 135380 - RNA, 21 nt, Human
gcaguguuggagugaggaccu

SEQ ID NO: 135381 - RNA, 23 nt, Human
aggaggcaaaagccccugcuucu

SEQ ID NO: 135382 - RNA, 25 nt, Human
agccuuccuggauuucacgcauccc

SEQ ID NO: 135383 - RNA, 27 nt, Human
ccuguucugaaacugauuagaagccug

SEQ ID NO: 135384 - RNA, 22 nt, Human
aggacagagacaaaaaugagga

SEQ ID NO: 135385 - RNA, 22 nt, Human
uuauccaggcugagauggaaaa

SEQ ID NO: 135386 - RNA, 24 nt, Human
cuuacuuuuuaccaggagugcagu

SEQ ID NO: 135387 - RNA, 18 nt, Human
uuugaaguauugcugcua

SEQ ID NO: 135388 - RNA, 20 nt, Human
ggaacuuugggacucacuug

SEQ ID NO: 135389 - RNA, 23 nt, Human
acaaucacggcucacugcagccu

SEQ ID NO: 135390 - RNA, 21 nt, Human
cacucucauccuacgggccac

SEQ ID NO: 135391 - RNA, 22 nt, Human
agacuccugggcuucagccucu

SEQ ID NO: 135392 - RNA, 22 nt, Human
auuucauuuaauuuuagccaca

SEQ ID NO: 135393 - RNA, 25 nt, Human
ucuucaggcgccucccuucucucca

SEQ ID NO: 135394 - RNA, 22 nt, Human
guuucaccuuuucccucucugg

SEQ ID NO: 135395 - RNA, 26 nt, Human
acagcaggugcagguuucccagcagc

SEQ ID NO: 135396 - RNA, 27 nt, Human
ccacugcacuccagccuggugacuccg

SEQ ID NO: 135397 - RNA, 26 nt, Human
aguccuuuaaccagcacagccaguua

SEQ ID NO: 135398 - RNA, 19 nt, Human
auauuucuccagacuugca

SEQ ID NO: 135399 - RNA, 20 nt, Human
gaguacuaagccccaguaag

SEQ ID NO: 135400 - RNA, 20 nt, Human
ccagagaaugcccacugccu

SEQ ID NO: 135401 - RNA, 27 nt, Human
uugcccaaaaggcuggagagggcaggg

SEQ ID NO: 135402 - RNA, 23 nt, Human
agccccucaugcuccugccuucc

SEQ ID NO: 135403 - RNA, 21 nt, Human
agacagcagucuuaugcuucc

SEQ ID NO: 135404 - RNA, 22 nt, Human
gguacgggucuuccugccucau

SEQ ID NO: 135405 - RNA, 21 nt, Human
cagggagggggucugagucgc

SEQ ID NO: 135406 - RNA, 22 nt, Human
gggauuacaggugugagccacc

SEQ ID NO: 135407 - RNA, 21 nt, Human
cccagagcccagagcaaccag

SEQ ID NO: 135408 - RNA, 21 nt, Human
auggggaagcaacauuuuuau

SEQ ID NO: 135409 - RNA, 23 nt, Human
gaagcaguucacuuaaaggccau

SEQ ID NO: 135410 - RNA, 22 nt, Human
ccagcgaucucuccacugugcu

SEQ ID NO: 135411 - RNA, 20 nt, Human
acuaccuggagagaacuuag

SEQ ID NO: 135412 - RNA, 20 nt, Human
ucaccaggcuguaagcaaua

SEQ ID NO: 135413 - RNA, 20 nt, Human
guucaaauauucaagaaggu

SEQ ID NO: 135414 - RNA, 23 nt, Human
ccagcaaggcccugccagcccac

SEQ ID NO: 135415 - RNA, 22 nt, Human
agauuucagauauucugcucua

SEQ ID NO: 135416 - RNA, 23 nt, Human
ugugccgccgcuuuccuccucca

SEQ ID NO: 135417 - RNA, 21 nt, Human
caccagcaaagcgcagaaagg

SEQ ID NO: 135418 - RNA, 29 nt, Human
aguaaucauuaguggcaaugaugacauuc

SEQ ID NO: 135419 - RNA, 22 nt, Human
uggcucuuucacaugugcuuua

SEQ ID NO: 135420 - RNA, 27 nt, Human
augugguggugguugugcccagcacag

SEQ ID NO: 135421 - RNA, 18 nt, Human
uacagaagccauugaaaa

SEQ ID NO: 135422 - RNA, 22 nt, Human
uaacucuguacaucagaagaga

SEQ ID NO: 135423 - RNA, 27 nt, Human
guagggaguuguggguaguggggaaga

SEQ ID NO: 135424 - RNA, 25 nt, Human
ccccaggaacccuugagguucuucu

SEQ ID NO: 135425 - RNA, 18 nt, Human
cccugacaggugcccuca

SEQ ID NO: 135426 - RNA, 29 nt, Human
gcccagcuucuccuuaccugcacccaggc

SEQ ID NO: 135427 - RNA, 22 nt, Human
guuucaaacuccugaccucagg

SEQ ID NO: 135428 - RNA, 23 nt, Human
agccaucaugugccuggaaauua

SEQ ID NO: 135429 - RNA, 21 nt, Human
gcuagucuugaacuccuggcc

SEQ ID NO: 135430 - RNA, 19 nt, Human
ucaugcuuguuccucccuc

SEQ ID NO: 135431 - RNA, 27 nt, Human
cggcaggcagugguucgguuuaagaga

SEQ ID NO: 135432 - RNA, 22 nt, Human
auuugacaaauaggacugccua

SEQ ID NO: 135433 - RNA, 22 nt, Human
cucauggagaaauggauagaaa

SEQ ID NO: 135434 - RNA, 24 nt, Human
acccuagcuuggguggcaaagcaa

SEQ ID NO: 135435 - RNA, 22 nt, Human
agacaguucuuucugcuacuga

SEQ ID NO: 135436 - RNA, 23 nt, Human
gccagccaggaagaugaauccua

SEQ ID NO: 135437 - RNA, 21 nt, Human
cugcagcagagauaaugguga

SEQ ID NO: 135438 - RNA, 21 nt, Human
guagugagcugaagucccgcc

SEQ ID NO: 135439 - RNA, 26 nt, Human
gguaaucagcucaguguguuacuggu

SEQ ID NO: 135440 - RNA, 21 nt, Human
caggccugacucgcugcucuu

SEQ ID NO: 135441 - RNA, 26 nt, Human
cucaggcugaucucaaacuccugggc

SEQ ID NO: 135442 - RNA, 24 nt, Human
uccuggaauaacaugucaucuuca

SEQ ID NO: 135443 - RNA, 20 nt, Human
agccuggaccagccaccuca

SEQ ID NO: 135444 - RNA, 22 nt, Human
uugaagccguacugcuuuuuug

SEQ ID NO: 135445 - RNA, 20 nt, Human
auagcuuaagcaaguuuaca

SEQ ID NO: 135446 - RNA, 19 nt, Human
aaacucagagaaucaaaga

SEQ ID NO: 135447 - RNA, 22 nt, Human
gagcgagauucugccucaaaaa

SEQ ID NO: 135448 - RNA, 32 nt, Human
uccucggccgccgccgccucuggaccgcgagc

SEQ ID NO: 135449 - RNA, 22 nt, Human
uaccuguuauaccagcacuuug

SEQ ID NO: 135450 - RNA, 24 nt, Human
ggaucucggccccgggaggcgggc

SEQ ID NO: 135451 - RNA, 23 nt, Human
gaagaaauuuaaucagugugaca

SEQ ID NO: 135452 - RNA, 22 nt, Human
ggaggcugagacgcaaggauca

SEQ ID NO: 135453 - RNA, 25 nt, Human
aucugccagcgagaaucggcuacag

SEQ ID NO: 135454 - RNA, 21 nt, Human
ucugggucucuaaucugugcu

SEQ ID NO: 135455 - RNA, 21 nt, Human
uuucuccucucucacccacac

SEQ ID NO: 135456 - RNA, 26 nt, Human
uucuuagcuugucugugaucucugcu

SEQ ID NO: 135457 - RNA, 19 nt, Human
cucauagcuuauuuuaguu

SEQ ID NO: 135458 - RNA, 19 nt, Human
ugaaggaaugugggcccag

SEQ ID NO: 135459 - RNA, 21 nt, Human
gcugguggacggugaugagga

SEQ ID NO: 135460 - RNA, 18 nt, Human
accaaagaagaguuuaca

SEQ ID NO: 135461 - RNA, 27 nt, Human
ucaggagguugaggcagcagaauugcu

SEQ ID NO: 135462 - RNA, 22 nt, Human
caccuucagauuguagcuuuga

SEQ ID NO: 135463 - RNA, 21 nt, Human
gggcagcagccguugcucaga

SEQ ID NO: 135464 - RNA, 27 nt, Human
aguucucugaggaugguucuacaguug

SEQ ID NO: 135465 - RNA, 27 nt, Human
ccgucucucacuggauuggugccaccu

SEQ ID NO: 135466 - RNA, 24 nt, Human
gcagcucaaaaugauauguuugag

SEQ ID NO: 135467 - RNA, 25 nt, Human
ggacuccuggucuccuccggggaug

SEQ ID NO: 135468 - RNA, 24 nt, Human
uccacuccuuacaucaccgccacu

SEQ ID NO: 135469 - RNA, 22 nt, Human
ccugcugcugcugccguuccgg

SEQ ID NO: 135470 - RNA, 27 nt, Human
ucggaaagauggagcaagaagccgagc

SEQ ID NO: 135471 - RNA, 20 nt, Human
gcaccaccucccuucaguca

SEQ ID NO: 135472 - RNA, 27 nt, Human
aggguucugccucuccaggcauuagcc

SEQ ID NO: 135473 - RNA, 21 nt, Human
uggugacaguccaaaccacuc

SEQ ID NO: 135474 - RNA, 18 nt, Human
augaguguaugugccagu

SEQ ID NO: 135475 - RNA, 24 nt, Human
auuagcagcuuuuccuccucuucc

SEQ ID NO: 135476 - RNA, 19 nt, Human
aaaaagauaccaauaacac

SEQ ID NO: 135477 - RNA, 24 nt, Human
aucuuugaaggaggaaacugauga

SEQ ID NO: 135478 - RNA, 28 nt, Human
cuugcgcagguacauguucccuagcuga

SEQ ID NO: 135479 - RNA, 24 nt, Human
cgucucugucucugggccuuuguu

SEQ ID NO: 135480 - RNA, 23 nt, Human
ucccucguucuccaccugcucug

SEQ ID NO: 135481 - RNA, 27 nt, Human
cuuugaggcugugguugggaauuugua

SEQ ID NO: 135482 - RNA, 25 nt, Human
aaugucaucccuaaugacacaugcc

SEQ ID NO: 135483 - RNA, 19 nt, Human
cagggacugcgcucccuug

SEQ ID NO: 135484 - RNA, 22 nt, Human
ucuuccuugccacaaucacuaa

SEQ ID NO: 135485 - RNA, 24 nt, Human
gcuucucuucauauaacugagcug

SEQ ID NO: 135486 - RNA, 22 nt, Human
uauuccauauuaauaggcuugc

SEQ ID NO: 135487 - RNA, 22 nt, Human
gggcugagaagauccugaguac

SEQ ID NO: 135488 - RNA, 25 nt, Human
gagagugagacccaguggagggagc

SEQ ID NO: 135489 - RNA, 21 nt, Human
gaggaagaaagaacucaagua

SEQ ID NO: 135490 - RNA, 26 nt, Human
gcugaucaggaaagaauuucgcucuu

SEQ ID NO: 135491 - RNA, 21 nt, Human
uggcuacgccuguaaucccag

SEQ ID NO: 135492 - RNA, 17 nt, Human
caaugguuaacaucuuc

SEQ ID NO: 135493 - RNA, 22 nt, Human
aaagguuuguuucccagauuug

SEQ ID NO: 135494 - RNA, 21 nt, Human
ugcccuacugggagacuggga

SEQ ID NO: 135495 - RNA, 26 nt, Human
gugcccagagcacaagacugggggca

SEQ ID NO: 135496 - RNA, 25 nt, Human
cgggaggcggguuauggcggcggcg

SEQ ID NO: 135497 - RNA, 24 nt, Human
gcugccuuggcccugcuuggcuga

SEQ ID NO: 135498 - RNA, 20 nt, Human
uuucagcugugagcuuucug

SEQ ID NO: 135499 - RNA, 20 nt, Human
ggagguagaggccagggcag

SEQ ID NO: 135500 - RNA, 27 nt, Human
ggccucggucccuccugcaccugcugc

SEQ ID NO: 135501 - RNA, 24 nt, Human
cccagaauauuuagaaauguagaa

SEQ ID NO: 135502 - RNA, 24 nt, Human
cccugaaauccucagucuccuugg

SEQ ID NO: 135503 - RNA, 26 nt, Human
acgguuuuacugcagcuuuguuuguu

SEQ ID NO: 135504 - RNA, 23 nt, Human
ucaucccacagucccuucucucc

SEQ ID NO: 135505 - RNA, 23 nt, Human
uccuagccccugucauggugucc

SEQ ID NO: 135506 - RNA, 26 nt, Human
ggagccauaaugugcauaugugcaca

SEQ ID NO: 135507 - RNA, 27 nt, Human
ugggacccucugcccgucuucucucca

SEQ ID NO: 135508 - RNA, 22 nt, Human
caccuccagggucuuaagaguc

SEQ ID NO: 135509 - RNA, 20 nt, Human
aagcaguucuuaguagaggc

SEQ ID NO: 135510 - RNA, 27 nt, Human
ggggagcagaggggcagaggcccacau

SEQ ID NO: 135511 - RNA, 23 nt, Human
ccaggccccaggcaucuuugccu

SEQ ID NO: 135512 - RNA, 22 nt, Human
cucagcuuuauaacaaaugugg

SEQ ID NO: 135513 - RNA, 22 nt, Human
aggagcugugggcgcagggccu

SEQ ID NO: 135514 - RNA, 22 nt, Human
ccuuucucuucuuccccagguc

SEQ ID NO: 135515 - RNA, 18 nt, Human
ucaagaguccuggaaucu

SEQ ID NO: 135516 - RNA, 21 nt, Human
guggugaaaugaaaauggagc

SEQ ID NO: 135517 - RNA, 21 nt, Human
ggaggcggagguuguagugag

SEQ ID NO: 135518 - RNA, 27 nt, Human
cccaggaguuuaaggcugcagugagcu

SEQ ID NO: 135519 - RNA, 20 nt, Human
auaucuccuguucucugaga

SEQ ID NO: 135520 - RNA, 21 nt, Human
ucucauucaagaaggcauaca

SEQ ID NO: 135521 - RNA, 21 nt, Human
gggagucucccugaccugcuc

SEQ ID NO: 135522 - RNA, 22 nt, Human
cacugcauuccagccuggguga

SEQ ID NO: 135523 - RNA, 22 nt, Human
ccaaagugauggaauuacaggu

SEQ ID NO: 135524 - RNA, 27 nt, Human
auccuuuuuaaaugagacuuguuuucc

SEQ ID NO: 135525 - RNA, 18 nt, Human
auucacuuuaccuagcag

SEQ ID NO: 135526 - RNA, 27 nt, Human
gugaacaaacccccacuccguuguauu

SEQ ID NO: 135527 - RNA, 27 nt, Human
agcauuuuaagaggugcagccucugga

SEQ ID NO: 135528 - RNA, 19 nt, Human
ccaccucucuuuuucaguu

SEQ ID NO: 135529 - RNA, 22 nt, Human
ccuuaugguuuaggccuugcca

SEQ ID NO: 135530 - RNA, 23 nt, Human
cgcagagguggaucgacgcccag

SEQ ID NO: 135531 - RNA, 22 nt, Human
cugcugaggcacaagaaucauu

SEQ ID NO: 135532 - RNA, 20 nt, Human
ugccaggcuggaguggagug

SEQ ID NO: 135533 - RNA, 19 nt, Human
auauauacauuuugcagcu

SEQ ID NO: 135534 - RNA, 27 nt, Human
gagggagagugcagccaggcucaggga

SEQ ID NO: 135535 - RNA, 22 nt, Human
ggugaggcaggagcugggaggg

SEQ ID NO: 135536 - RNA, 20 nt, Human
ccucuggucgcuccugccca

SEQ ID NO: 135537 - RNA, 27 nt, Human
cgaguucaagcaauucuccugccucag

SEQ ID NO: 135538 - RNA, 26 nt, Human
auugccccuaucuugugcucuucugu

SEQ ID NO: 135539 - RNA, 20 nt, Human
ccccgcaggggccuagaggg

SEQ ID NO: 135540 - RNA, 23 nt, Human
augacucuaaagaaacagaagau

SEQ ID NO: 135541 - RNA, 27 nt, Human
gcaggaagucccugagaagccucaugg

SEQ ID NO: 135542 - RNA, 22 nt, Human
gggagguagagguugcacugag

SEQ ID NO: 135543 - RNA, 20 nt, Human
cugacuuggaaaguuggaga

SEQ ID NO: 135544 - RNA, 20 nt, Human
agcuccagagagcugccuuc

SEQ ID NO: 135545 - RNA, 21 nt, Human
gcaauggcucaucagauucaa

SEQ ID NO: 135546 - RNA, 22 nt, Human
ccauauuuucaaccacucugau

SEQ ID NO: 135547 - RNA, 24 nt, Human
ccaacaacauggggcucaggucug

SEQ ID NO: 135548 - RNA, 23 nt, Human
agccccuguggccucuuggagag

SEQ ID NO: 135549 - RNA, 27 nt, Human
accgaguaccugcugaacgccuacucu

SEQ ID NO: 135550 - RNA, 22 nt, Human
ugcagugagcugagauugcgcc

SEQ ID NO: 135551 - RNA, 22 nt, Human
ugcagugagccgagauugugcc

SEQ ID NO: 135552 - RNA, 22 nt, Human
uguggugagccgagauugcacc

SEQ ID NO: 135553 - RNA, 16 nt, Human
cgccucucccaccucc

SEQ ID NO: 135554 - RNA, 20 nt, Human
aacuuuguacuauucacauu

SEQ ID NO: 135555 - RNA, 21 nt, Human
cugcuuuuaaaagugcacauu

SEQ ID NO: 135556 - RNA, 19 nt, Human
ggauggaagaaggagccag

SEQ ID NO: 135557 - RNA, 20 nt, Human
uugaggaccuuguguuccug

SEQ ID NO: 135558 - RNA, 27 nt, Human
aaggcuccacucuguagccaggugcaa

SEQ ID NO: 135559 - RNA, 22 nt, Human
gaagcagcugagacuguuggag

SEQ ID NO: 135560 - RNA, 24 nt, Human
aaugauguguugguuuacagggua

SEQ ID NO: 135561 - RNA, 23 nt, Human
cucugguugggaguaugauauga

SEQ ID NO: 135562 - RNA, 24 nt, Human
agccccuugcuaaccucagcucuu

SEQ ID NO: 135563 - RNA, 22 nt, Human
gguggcgccugcucuccaucca

SEQ ID NO: 135564 - RNA, 27 nt, Human
cagcaguccacaaagcauuuucauuuc

SEQ ID NO: 135565 - RNA, 26 nt, Human
agaggaagaaugagagcuuugugugu

SEQ ID NO: 135566 - RNA, 21 nt, Human
cguccucuuccuugucuuggc

SEQ ID NO: 135567 - RNA, 22 nt, Human
cuguacugcugcauuuccuguc

SEQ ID NO: 135568 - RNA, 21 nt, Human
caacaaauaaacacauguugc

SEQ ID NO: 135569 - RNA, 20 nt, Human
ucucugcaggucgagcccag

SEQ ID NO: 135570 - RNA, 26 nt, Human
caacauuggaugugcauuucugugau

SEQ ID NO: 135571 - RNA, 19 nt, Human
cuaccugcuauagcacacu

SEQ ID NO: 135572 - RNA, 24 nt, Human
cuggggcagggcagccagguucca

SEQ ID NO: 135573 - RNA, 24 nt, Human
ugaguugacacagggagcuccagg

SEQ ID NO: 135574 - RNA, 23 nt, Human
agcuuuguuuguucuuguuuuua

SEQ ID NO: 135575 - RNA, 22 nt, Human
gcgcucaggaggcagagguuac

SEQ ID NO: 135576 - RNA, 20 nt, Human
ucucucgccuuccuauuucu

SEQ ID NO: 135577 - RNA, 19 nt, Human
uuuguuuuguuugagacuc

SEQ ID NO: 135578 - RNA, 24 nt, Human
ccccacccugcccugcucagggug

SEQ ID NO: 135579 - RNA, 24 nt, Human
acugccuuugcaacacugcaguuu

SEQ ID NO: 135580 - RNA, 19 nt, Human
uaauguuuucaagugccuu

SEQ ID NO: 135581 - RNA, 27 nt, Human
ugggacccccacccauccaggcccuuu

SEQ ID NO: 135582 - RNA, 21 nt, Human
cacugcacuucagcguggccc

SEQ ID NO: 135583 - RNA, 26 nt, Human
cugccucuccgccccugagcccacug

SEQ ID NO: 135584 - RNA, 20 nt, Human
gaacagcuuuagucauggaa

SEQ ID NO: 135585 - RNA, 22 nt, Human
cacccaggcuggagugcaguag

SEQ ID NO: 135586 - RNA, 25 nt, Human
gcaaaugguuuugggcaagggcuuu

SEQ ID NO: 135587 - RNA, 24 nt, Human
cucgcuggcuuugcacagccuguc

SEQ ID NO: 135588 - RNA, 29 nt, Human
ugagguuggggucaaugccuccugggcac

SEQ ID NO: 135589 - RNA, 21 nt, Human
ccuucuccccauucugccucc

SEQ ID NO: 135590 - RNA, 26 nt, Human
uguaaauugcuacuuuguauuuuaug

SEQ ID NO: 135591 - RNA, 25 nt, Human
gggggccugggcaccgcaggaagac

SEQ ID NO: 135592 - RNA, 27 nt, Human
ucccuccaggagaucccagggugcaaa

SEQ ID NO: 135593 - RNA, 21 nt, Human
gcaaccucuaccuccuggguu

SEQ ID NO: 135594 - RNA, 22 nt, Human
ugggaaaugaaagaaagagaua

SEQ ID NO: 135595 - RNA, 24 nt, Human
ucagcacucugugggucuggugau

SEQ ID NO: 135596 - RNA, 23 nt, Human
gagcgugaaucuguaucuugccg

SEQ ID NO: 135597 - RNA, 23 nt, Human
gaugggguuucaccguguuaguc

SEQ ID NO: 135598 - RNA, 24 nt, Human
gccuuccuuucucucuccugugaa

SEQ ID NO: 135599 - RNA, 21 nt, Human
gccugccugcucccccuggcc

SEQ ID NO: 135600 - RNA, 22 nt, Human
guuuuaggggccugggcugggg

SEQ ID NO: 135601 - RNA, 18 nt, Human
ccaccuccagccugggag

SEQ ID NO: 135602 - RNA, 22 nt, Human
uuccaccucagcucuagaagcc

SEQ ID NO: 135603 - RNA, 23 nt, Human
aaagugcuggcacuuacacccac

SEQ ID NO: 135604 - RNA, 20 nt, Human
ccuuaucugcuaacucuguu

SEQ ID NO: 135605 - RNA, 27 nt, Human
ucucaucuuauuaaccauuucuugccu

SEQ ID NO: 135606 - RNA, 20 nt, Human
gcuucaaaacauugauaauu

SEQ ID NO: 135607 - RNA, 30 nt, Human
uccucgagguugagcuucacuccacugcgg

SEQ ID NO: 135608 - RNA, 21 nt, Human
aaccaaauggagugacuuagu

SEQ ID NO: 135609 - RNA, 27 nt, Human
ugcuuuucaaccuuucucucccgaaca

SEQ ID NO: 135610 - RNA, 28 nt, Human
uccaugcuccagggucaggcggagcugc

SEQ ID NO: 135611 - RNA, 22 nt, Human
ccuucucccuccagcuccacuc

SEQ ID NO: 135612 - RNA, 27 nt, Human
ucuuagcaacauuuucuuuuucuuuuu

SEQ ID NO: 135613 - RNA, 19 nt, Human
aacacaaaagagcagagca

SEQ ID NO: 135614 - RNA, 17 nt, Human
ucuuaaaagaugccuua

SEQ ID NO: 135615 - RNA, 22 nt, Human
gucacugagaguuuggcuuaga

SEQ ID NO: 135616 - RNA, 19 nt, Human
uuuucuagucuacuucaaa

SEQ ID NO: 135617 - RNA, 18 nt, Human
cuucccuuaucccugcuc

SEQ ID NO: 135618 - RNA, 21 nt, Human
gugcuggccccucugcagaug

SEQ ID NO: 135619 - RNA, 21 nt, Human
uccaguuuuuugccacugcaa

SEQ ID NO: 135620 - RNA, 20 nt, Human
ccccacucugcucugaugca

SEQ ID NO: 135621 - RNA, 23 nt, Human
ugcuuuccuguccugccagagca

SEQ ID NO: 135622 - RNA, 26 nt, Human
ucuggcccaccuccuuuuuaauguaa

SEQ ID NO: 135623 - RNA, 26 nt, Human
guucugcuggaauucugcauccagcu

SEQ ID NO: 135624 - RNA, 24 nt, Human
ccuuagcagcugcaccgccauccc

SEQ ID NO: 135625 - RNA, 19 nt, Human
cacccaggcagggagcaag

SEQ ID NO: 135626 - RNA, 22 nt, Human
auuugggaaaaagaaaagcuuc

SEQ ID NO: 135627 - RNA, 20 nt, Human
uuuaaaacaaauuuucaugg

SEQ ID NO: 135628 - RNA, 22 nt, Human
agaccagccugggcagcauagc

SEQ ID NO: 135629 - RNA, 23 nt, Human
agugucaggaauauugguuugaa

SEQ ID NO: 135630 - RNA, 21 nt, Human
cagacuuuaaagccaccaggg

SEQ ID NO: 135631 - RNA, 27 nt, Human
gugcucacccacccgcagccuaggcag

SEQ ID NO: 135632 - RNA, 25 nt, Human
uggugacgggcgccuguaaucccag

SEQ ID NO: 135633 - RNA, 22 nt, Human
uaucuguguuuuugaaauauua

SEQ ID NO: 135634 - RNA, 22 nt, Human
guugacuggcuuuccucucguu

SEQ ID NO: 135635 - RNA, 23 nt, Human
agugcuguuuccuauuggacuga

SEQ ID NO: 135636 - RNA, 26 nt, Human
acauuucuuucuccauucuguuccac

SEQ ID NO: 135637 - RNA, 21 nt, Human
agggaugagggagggaggggc

SEQ ID NO: 135638 - RNA, 20 nt, Human
uguuaacugcaaccuuguuu

SEQ ID NO: 135639 - RNA, 20 nt, Human
gagcauauauuuuacuguca

SEQ ID NO: 135640 - RNA, 26 nt, Human
uuuuuuaaaaagguuucauuuuccua

SEQ ID NO: 135641 - RNA, 21 nt, Human
ggggccuggggcucucaggga

SEQ ID NO: 135642 - RNA, 21 nt, Human
gcuaagcugccuuugccuucu

SEQ ID NO: 135643 - RNA, 27 nt, Human
caccaguacauuauauguuguaauauu

SEQ ID NO: 135644 - RNA, 24 nt, Human
acccuggagaaggguaaacccccg

SEQ ID NO: 135645 - RNA, 21 nt, Human
uggggugagaggaugggugau

SEQ ID NO: 135646 - RNA, 20 nt, Human
augggaaaggaggcaugccu

SEQ ID NO: 135647 - RNA, 22 nt, Human
aauugcugggauuuacaggcau

SEQ ID NO: 135648 - RNA, 20 nt, Human
uuccagugggacauggugcc

SEQ ID NO: 135649 - RNA, 25 nt, Human
cugucucccaggcuggagugcaaug

SEQ ID NO: 135650 - RNA, 23 nt, Human
aggcuccugaggucaagcuucca

SEQ ID NO: 135651 - RNA, 22 nt, Human
uucucagagagccuaaauucua

SEQ ID NO: 135652 - RNA, 20 nt, Human
ccaagaauggccacugugcc

SEQ ID NO: 135653 - RNA, 16 nt, Human
uucccucugcucagcc

SEQ ID NO: 135654 - RNA, 20 nt, Human
uguugaauuggcacuuucua

SEQ ID NO: 135655 - RNA, 23 nt, Human
uuuuugaauagccuacucccaag

SEQ ID NO: 135656 - RNA, 32 nt, Human
cuggagccuaggaaaguggcccccaaauccuu

SEQ ID NO: 135657 - RNA, 22 nt, Human
ccuaaguugcugggauuacagg

SEQ ID NO: 135658 - RNA, 24 nt, Human
aacaacaaaauggggacuucuuug

SEQ ID NO: 135659 - RNA, 25 nt, Human
caaguguccacugguacugagguuu

SEQ ID NO: 135660 - RNA, 21 nt, Human
uauuauucaaccaagcuucua

SEQ ID NO: 135661 - RNA, 21 nt, Human
ugcccugcuuucagauacugg

SEQ ID NO: 135662 - RNA, 19 nt, Human
uagaagcuaaucuauacca

SEQ ID NO: 135663 - RNA, 30 nt, Human
caaggcaguucugcuccccaucguccucuu

SEQ ID NO: 135664 - RNA, 24 nt, Human
ucuccugccucagcuucccgagua

SEQ ID NO: 135665 - RNA, 21 nt, Human
gggagcgggagccggagcagc

SEQ ID NO: 135666 - RNA, 20 nt, Human
uagcucuucagagaagccuc

SEQ ID NO: 135667 - RNA, 25 nt, Human
ugcuuuuauaggccuguguguauag

SEQ ID NO: 135668 - RNA, 22 nt, Human
uauuaaaucacuguucucccca

SEQ ID NO: 135669 - RNA, 22 nt, Human
ggagaguuuuuugaaauggcag

SEQ ID NO: 135670 - RNA, 22 nt, Human
guuuuucuguuaucauaauuuu

SEQ ID NO: 135671 - RNA, 25 nt, Human
uuuuugcuuauaaucacuuuacuua

SEQ ID NO: 135672 - RNA, 21 nt, Human
cugcauccugccugccagggc

SEQ ID NO: 135673 - RNA, 22 nt, Human
agcucgaagaagauaugaauca

SEQ ID NO: 135674 - RNA, 22 nt, Human
ccauuuuacaggugagagaacc

SEQ ID NO: 135675 - RNA, 26 nt, Human
ucugccuggcgggcgcuggagccugc

SEQ ID NO: 135676 - RNA, 22 nt, Human
gccucacggcgauccuggacug

SEQ ID NO: 135677 - RNA, 21 nt, Human
cugagauuuugaggcaguugc

SEQ ID NO: 135678 - RNA, 26 nt, Human
cagcucuucuccuggaaugacuggcu

SEQ ID NO: 135679 - RNA, 23 nt, Human
gccuguguccuacagaugcacac

SEQ ID NO: 135680 - RNA, 21 nt, Human
aagaacgauauaaauacauua

SEQ ID NO: 135681 - RNA, 21 nt, Human
ucgucgggggcggcgggcgga

SEQ ID NO: 135682 - RNA, 22 nt, Human
uucuccggcuuccucuggccca

SEQ ID NO: 135683 - RNA, 22 nt, Human
aguaaacauuccaacauugucu

SEQ ID NO: 135684 - RNA, 22 nt, Human
uugcgccacuacacuccagccu

SEQ ID NO: 135685 - RNA, 23 nt, Human
augacugcagaauugagagaagc

SEQ ID NO: 135686 - RNA, 23 nt, Human
acacagacuuggggaccugggga

SEQ ID NO: 135687 - RNA, 20 nt, Human
cauuuuuccuuugcuuucuc

SEQ ID NO: 135688 - RNA, 27 nt, Human
gccuugucuuuuccucucucugccuca

SEQ ID NO: 135689 - RNA, 20 nt, Human
acugugcuucccaccucccc

SEQ ID NO: 135690 - RNA, 22 nt, Human
cccaaauucuaacuauuucuuu

SEQ ID NO: 135691 - RNA, 24 nt, Human
cgcuaccucucugucccuugcugu

SEQ ID NO: 135692 - RNA, 22 nt, Human
ugcucacugcaaccucugccac

SEQ ID NO: 135693 - RNA, 22 nt, Human
ggacuuuggggucaggccuugc

SEQ ID NO: 135694 - RNA, 23 nt, Human
cucagacacuagggaaagguaaa

SEQ ID NO: 135695 - RNA, 26 nt, Human
cacuccucaaccuugacuucugccca

SEQ ID NO: 135696 - RNA, 20 nt, Human
uucuguaaucuguauuauug

SEQ ID NO: 135697 - RNA, 25 nt, Human
cccagacaauggcccaggucucuca

SEQ ID NO: 135698 - RNA, 23 nt, Human
uuuucuugaagaggcagcucaaa

SEQ ID NO: 135699 - RNA, 21 nt, Human
uggacagaacuacauucuuuc

SEQ ID NO: 135700 - RNA, 27 nt, Human
cacagccccaggcuuggugaggaagag

SEQ ID NO: 135701 - RNA, 24 nt, Human
gggaaagggaaaggaagcagggca

SEQ ID NO: 135702 - RNA, 18 nt, Human
cuccaaauacgccuucuu

SEQ ID NO: 135703 - RNA, 22 nt, Human
aagacaccuggaucagacucca

SEQ ID NO: 135704 - RNA, 21 nt, Human
acccagcuccuucuggucauu

SEQ ID NO: 135705 - RNA, 24 nt, Human
cccucauuucucaucuuuuuacua

SEQ ID NO: 135706 - RNA, 22 nt, Human
agaccuacuuucaacuccuuuu

SEQ ID NO: 135707 - RNA, 21 nt, Human
ucaaaacaauauuacuuuguc

SEQ ID NO: 135708 - RNA, 21 nt, Human
gcaagagauggggguguauug

SEQ ID NO: 135709 - RNA, 21 nt, Human
acaaaccuuaaacacccagaa

SEQ ID NO: 135710 - RNA, 19 nt, Human
auuacguuuaaagugcagu

SEQ ID NO: 135711 - RNA, 19 nt, Human
ugugaucuuuauuuugaaa

SEQ ID NO: 135712 - RNA, 24 nt, Human
caccugaggucaggaguuugagac

SEQ ID NO: 135713 - RNA, 23 nt, Human
gggcugagggacccaccuggccc

SEQ ID NO: 135714 - RNA, 21 nt, Human
uagcaagcuccgccuccuggg

SEQ ID NO: 135715 - RNA, 21 nt, Human
gccucucuucaggcugaacca

SEQ ID NO: 135716 - RNA, 26 nt, Human
gugaaugacguugcagggucuucaug

SEQ ID NO: 135717 - RNA, 23 nt, Human
ugccuguagucucagcuacucag

SEQ ID NO: 135718 - RNA, 22 nt, Human
cgugggcacugaaggcuuucag

SEQ ID NO: 135719 - RNA, 21 nt, Human
ccacccacacagcagccucca

SEQ ID NO: 135720 - RNA, 21 nt, Human
auaaagugguauugaaguacc

SEQ ID NO: 135721 - RNA, 25 nt, Human
cuccuccuucucugccuguuucccu

SEQ ID NO: 135722 - RNA, 20 nt, Human
gggaacaacaggggcuccug

SEQ ID NO: 135723 - RNA, 27 nt, Human
accagccuggccaacauaauuaaaaug

SEQ ID NO: 135724 - RNA, 24 nt, Human
ugaagcugcacaugaagcgggcgc

SEQ ID NO: 135725 - RNA, 26 nt, Human
ugaaugucuuuguuggaaaagaauac

SEQ ID NO: 135726 - RNA, 25 nt, Human
ggagcccggcccugcgccuccgcac

SEQ ID NO: 135727 - RNA, 19 nt, Human
uucuacaguacaugacccg

SEQ ID NO: 135728 - RNA, 22 nt, Human
ggagcacuagagagggaggggg

SEQ ID NO: 135729 - RNA, 20 nt, Human
cugggccccugcucuucccg

SEQ ID NO: 135730 - RNA, 21 nt, Human
ccagugaggaugcugcaguga

SEQ ID NO: 135731 - RNA, 21 nt, Human
cccaccccacccagcaccccu

SEQ ID NO: 135732 - RNA, 24 nt, Human
acuuccugauuugaaaggaggagg

SEQ ID NO: 135733 - RNA, 22 nt, Human
uuuguacagaccgagaggccag

SEQ ID NO: 135734 - RNA, 23 nt, Human
guugcccaggcuggagugcaacg

SEQ ID NO: 135735 - RNA, 20 nt, Human
uacagaaguuccaauucccu

SEQ ID NO: 135736 - RNA, 23 nt, Human
aggaagccuggcacccacuucug

SEQ ID NO: 135737 - RNA, 29 nt, Human
accccagcuccacuccagccuggcgucca

SEQ ID NO: 135738 - RNA, 22 nt, Human
ggucuuccccgaucccaccccc

SEQ ID NO: 135739 - RNA, 27 nt, Human
gaggaagaggaggcuucauggcugagg

SEQ ID NO: 135740 - RNA, 22 nt, Human
uccagguggaggaagagauaug

SEQ ID NO: 135741 - RNA, 21 nt, Human
gcagcaccuccuugauucuca

SEQ ID NO: 135742 - RNA, 27 nt, Human
uugagucuaucaaucaacuuaugcaga

SEQ ID NO: 135743 - RNA, 32 nt, Human
cugcccucaccucugugcccagccuggaaacc

SEQ ID NO: 135744 - RNA, 22 nt, Human
ccugcaguuuagagaaggcaga

SEQ ID NO: 135745 - RNA, 23 nt, Human
uguccccagaaagcagcugcugu

SEQ ID NO: 135746 - RNA, 19 nt, Human
ccaucaaccaccucugcgg

SEQ ID NO: 135747 - RNA, 22 nt, Human
agaucaaggcaagaaccucuuu

SEQ ID NO: 135748 - RNA, 25 nt, Human
cuccagacauacaaacauaaggcac

SEQ ID NO: 135749 - RNA, 23 nt, Human
gggcaauugcguugcucaaauca

SEQ ID NO: 135750 - RNA, 25 nt, Human
uucauucucuaaugaaaacaaaaca

SEQ ID NO: 135751 - RNA, 21 nt, Human
guuucauaguuuucuaaaugu

SEQ ID NO: 135752 - RNA, 23 nt, Human
cuauuuacagucuguaacuuucc

SEQ ID NO: 135753 - RNA, 22 nt, Human
ggaaaaaauauuuuaaacuacu

SEQ ID NO: 135754 - RNA, 25 nt, Human
ugaaaacaagcucagagacuugauc

SEQ ID NO: 135755 - RNA, 22 nt, Human
gagacuaaagaaaauuuucaag

SEQ ID NO: 135756 - RNA, 22 nt, Human
ugcccaggcuggagugcagagg

SEQ ID NO: 135757 - RNA, 25 nt, Human
cuccacccucccuccccucccggcu

SEQ ID NO: 135758 - RNA, 27 nt, Human
ucaggaggcugaggcaggagaauuugc

SEQ ID NO: 135759 - RNA, 25 nt, Human
gcucucaucgguuggcuucauuuuc

SEQ ID NO: 135760 - RNA, 26 nt, Human
cuuuauuguuuugauguaauggaacu

SEQ ID NO: 135761 - RNA, 20 nt, Human
gaagaaaagaagcaaacuuc

SEQ ID NO: 135762 - RNA, 19 nt, Human
cauuaucaaaguccucuua

SEQ ID NO: 135763 - RNA, 21 nt, Human
uugcuuuuggacaaaaaugca

SEQ ID NO: 135764 - RNA, 20 nt, Human
acuuuuuuguaguuuuuugu

SEQ ID NO: 135765 - RNA, 27 nt, Human
gucuugaacucuugggcucaagugauc

SEQ ID NO: 135766 - RNA, 21 nt, Human
uugcccaaccuggagugcagu

SEQ ID NO: 135767 - RNA, 21 nt, Human
aagggaggggaaggaaugagc

SEQ ID NO: 135768 - RNA, 21 nt, Human
caguuauucuggaauaaggca

SEQ ID NO: 135769 - RNA, 22 nt, Human
ugagacaaagucucacuguguc

SEQ ID NO: 135770 - RNA, 18 nt, Human
ugaagauauucaaacuua

SEQ ID NO: 135771 - RNA, 26 nt, Human
gcccccucccuuccugcccccagucu

SEQ ID NO: 135772 - RNA, 23 nt, Human
acuaaggucgagagucucugugg

SEQ ID NO: 135773 - RNA, 21 nt, Human
auccuugcccuucucagggcu

SEQ ID NO: 135774 - RNA, 19 nt, Human
ugucaucugauauacacau

SEQ ID NO: 135775 - RNA, 21 nt, Human
uaagugaagauggaaggcugg

SEQ ID NO: 135776 - RNA, 24 nt, Human
gaaaggagagccaggagcauuuaa

SEQ ID NO: 135777 - RNA, 27 nt, Human
gugucaaacuccugggcucagucaguc

SEQ ID NO: 135778 - RNA, 21 nt, Human
ugagggggacacuaugucuuu

SEQ ID NO: 135779 - RNA, 22 nt, Human
ugguggaggagcugagggaggg

SEQ ID NO: 135780 - RNA, 20 nt, Human
agcaaacuaaaaagaacauu

SEQ ID NO: 135781 - RNA, 22 nt, Human
uucacaugauucuccugccuca

SEQ ID NO: 135782 - RNA, 24 nt, Human
cccuacacccucccccuccaggga

SEQ ID NO: 135783 - RNA, 22 nt, Human
ccggggggacccugacacugac

SEQ ID NO: 135784 - RNA, 23 nt, Human
aagcuuuagaucaagcuugucca

SEQ ID NO: 135785 - RNA, 27 nt, Human
ccagaagccucugccucccuagcuuuu

SEQ ID NO: 135786 - RNA, 24 nt, Human
agcucacugcagccuccaucuccu

SEQ ID NO: 135787 - RNA, 26 nt, Human
cacuuagggcaucuccugcugccuuc

SEQ ID NO: 135788 - RNA, 26 nt, Human
auucucucacaguguacucuauaaga

SEQ ID NO: 135789 - RNA, 20 nt, Human
caucuggagacaagugagaa

SEQ ID NO: 135790 - RNA, 22 nt, Human
cuuuucuguaaacaacuccagu

SEQ ID NO: 135791 - RNA, 21 nt, Human
uugguagcugggaaagcauaa

SEQ ID NO: 135792 - RNA, 23 nt, Human
uaggaucugugugcccagcacca

SEQ ID NO: 135793 - RNA, 26 nt, Human
acugguuuguuugcuuaauuuccuuc

SEQ ID NO: 135794 - RNA, 22 nt, Human
ugaacuccugaccucaacugau

SEQ ID NO: 135795 - RNA, 21 nt, Human
guagagcccuuugagaauaca

SEQ ID NO: 135796 - RNA, 18 nt, Human
ccauucuucacugaccca

SEQ ID NO: 135797 - RNA, 29 nt, Human
ugccucuaccucauggguauaaaguagga

SEQ ID NO: 135798 - RNA, 23 nt, Human
cagcucugcuucaggagcuauga

SEQ ID NO: 135799 - RNA, 26 nt, Human
gcaggaaggacugucccagacgaggg

SEQ ID NO: 135800 - RNA, 24 nt, Human
auaguaccacugcacaucauguuu

SEQ ID NO: 135801 - RNA, 26 nt, Human
gagagcaccuggugaucacgugguca

SEQ ID NO: 135802 - RNA, 22 nt, Human
cuugcugcuguguuuuuucuuc

SEQ ID NO: 135803 - RNA, 22 nt, Human
aggcgggcggaucacgagguca

SEQ ID NO: 135804 - RNA, 28 nt, Human
uugccuuaaaccucuuuauuucauugca

SEQ ID NO: 135805 - RNA, 22 nt, Human
cagccaggcugggccgcaaggg

SEQ ID NO: 135806 - RNA, 23 nt, Human
gacgggguuucacuguguuagcc

SEQ ID NO: 135807 - RNA, 23 nt, Human
uugaagccuuagaucucuccagc

SEQ ID NO: 135808 - RNA, 22 nt, Human
cacuguuucaucucagcuuuug

SEQ ID NO: 135809 - RNA, 25 nt, Human
cuccauuucuuggacuuaaaaugca

SEQ ID NO: 135810 - RNA, 24 nt, Human
uccaugaaggagaacaaaguggcc

SEQ ID NO: 135811 - RNA, 24 nt, Human
cucggcugcgcugcggcucaggcc

SEQ ID NO: 135812 - RNA, 26 nt, Human
accaauucuggcugucaauggggaga

SEQ ID NO: 135813 - RNA, 25 nt, Human
ggcaacagugccugcaaggccugaa

SEQ ID NO: 135814 - RNA, 30 nt, Human
cccagagggaggccaucucagucucuccac

SEQ ID NO: 135815 - RNA, 21 nt, Human
acuaaggagaaaaagaacaga

SEQ ID NO: 135816 - RNA, 21 nt, Human
caguugagcaaacaccaaccc

SEQ ID NO: 135817 - RNA, 27 nt, Human
ccugcagcgacucaacccuaugcaugg

SEQ ID NO: 135818 - RNA, 23 nt, Human
gucacucagguggcagcggcaga

SEQ ID NO: 135819 - RNA, 22 nt, Human
ugcagugagccaggauugugcc

SEQ ID NO: 135820 - RNA, 31 nt, Human; identical to SEQ ID NO: 4864

SEQ ID NO: 135821 - RNA, 26 nt, Human
cccucggggagcaacauggcagauaa

SEQ ID NO: 135822 - RNA, 20 nt, Human
ggagcccucccucucucccu

SEQ ID NO: 135823 - RNA, 22 nt, Human
ccaagucuccccuuugaagacu

SEQ ID NO: 135824 - RNA, 24 nt, Human
uaacaguugcaaggacacauacac

SEQ ID NO: 135825 - RNA, 21 nt, Human
uuagccugucucacaccaguu

SEQ ID NO: 135826 - RNA, 21 nt, Human
uuuuuuaaaaagguuuuucua

SEQ ID NO: 135827 - RNA, 25 nt, Human
uccccaggcugaaguguccucaggu

SEQ ID NO: 135828 - RNA, 26 nt, Human
gggugaggaucugagaaaugcuaaag

SEQ ID NO: 135829 - RNA, 22 nt, Human
acacccuggccugaacugagga

SEQ ID NO: 135830 - RNA, 24 nt, Human
agaugaacuagaagucacagguua

SEQ ID NO: 135831 - RNA, 26 nt, Human
uauuuggagggaaugggaggaagugg

SEQ ID NO: 135832 - RNA, 22 nt, Human
gguugaggacaggagagggaag

SEQ ID NO: 135833 - RNA, 22 nt, Human
auugcccaggcuguucuucaac

SEQ ID NO: 135834 - RNA, 21 nt, Human
uauuauuuucuauagcucuuc

SEQ ID NO: 135835 - RNA, 22 nt, Human
ccagggagggugagcuggugcc

SEQ ID NO: 135836 - RNA, 22 nt, Human
ccucugucccaaaaccucauuc

SEQ ID NO: 135837 - RNA, 24 nt, Human
ggguaaaagcccacccuacagaaa

SEQ ID NO: 135838 - RNA, 21 nt, Human
uuucauguuuuaaaaaucccu

SEQ ID NO: 135839 - RNA, 24 nt, Human
uuagauaaguaaauaacuaaagaa

SEQ ID NO: 135840 - RNA, 23 nt, Human
uaagauuauguuccuuauacuca

SEQ ID NO: 135841 - RNA, 22 nt, Human
ccaagaucgcgccacugcacuc

SEQ ID NO: 135842 - RNA, 22 nt, Human
ccgagaucgcaccacugcacuc

SEQ ID NO: 135843 - RNA, 22 nt, Human
cuaagaucgcgccacuguacuc

SEQ ID NO: 135844 - RNA, 19 nt, Human
uaugcuauagccugggcaa

SEQ ID NO: 135845 - RNA, 21 nt, Human
ugaccuaggacugaugcugug

SEQ ID NO: 135846 - RNA, 26 nt, Human
uaucaucugcauaucucuguaaguuc

SEQ ID NO: 135847 - RNA, 20 nt, Human
cauaaccugaacugugccga

SEQ ID NO: 135848 - RNA, 23 nt, Human
ccaucaguuacagagaauuuccu

SEQ ID NO: 135849 - RNA, 24 nt, Human
cgcucaagggguuauucuaccuca

SEQ ID NO: 135850 - RNA, 22 nt, Human
gcagacacucguccaaaccacu

SEQ ID NO: 135851 - RNA, 21 nt, Human
ggcucacugccaggccagccu

SEQ ID NO: 135852 - RNA, 22 nt, Human
ucuccuccucuuaccuuugugc

SEQ ID NO: 135853 - RNA, 22 nt, Human
ucuggagaagcagugagccgca

SEQ ID NO: 135854 - RNA, 21 nt, Human
cacagcuucuggcaccaugga

SEQ ID NO: 135855 - RNA, 23 nt, Human
auugugccacugcacuccagccg

SEQ ID NO: 135856 - RNA, 22 nt, Human
acugaugccauugugugcugcc

SEQ ID NO: 135857 - RNA, 23 nt, Human
uggggccacacacccaucuaccc

SEQ ID NO: 135858 - RNA, 21 nt, Human
cuuggaaaugaacacuuucug

SEQ ID NO: 135859 - RNA, 22 nt, Human
cagacuggagugcagugguggg

SEQ ID NO: 135860 - RNA, 30 nt, Human
aacacuguguccagcauucuuugcaauaaa

SEQ ID NO: 135861 - RNA, 27 nt, Human
cuaguuuaugaguccaaaugauauaga

SEQ ID NO: 135862 - RNA, 21 nt, Human
auguauuaccuggucauuuca

SEQ ID NO: 135863 - RNA, 23 nt, Human
cuuucucacuaagugagaaugag

SEQ ID NO: 135864 - RNA, 21 nt, Human
gcgacaacuuccaucauucca

SEQ ID NO: 135865 - RNA, 21 nt, Human
auuuuaaaaaccuagcuccuu

SEQ ID NO: 135866 - RNA, 30 nt, Human
ugggcaauaugacaaguauuacuuuuuggg

SEQ ID NO: 135867 - RNA, 22 nt, Human
ccaggcauggaaagauggggag

SEQ ID NO: 135868 - RNA, 26 nt, Human
uuagagaaaagagcaggaguccuggg

SEQ ID NO: 135869 - RNA, 26 nt, Human
uugaaggugguuagguaaaaugccug

SEQ ID NO: 135870 - RNA, 22 nt, Human
gcccgaggaguagucgcuggag

SEQ ID NO: 135871 - RNA, 25 nt, Human
accggacaccaccagacaauaggau

SEQ ID NO: 135872 - RNA, 26 nt, Human
ccugccucagccuccuggguagcugg

SEQ ID NO: 135873 - RNA, 27 nt, Human
caccacugugucccagugucuggccca

SEQ ID NO: 135874 - RNA, 21 nt, Human
cguagccuagagcagugucac

SEQ ID NO: 135875 - RNA, 22 nt, Human
ccugcagccuucccguguggcc

SEQ ID NO: 135876 - RNA, 23 nt, Human
guacaguguauuuaaauauuuca

SEQ ID NO: 135877 - RNA, 24 nt, Human
gguaaacucugacaugcacuagua

SEQ ID NO: 135878 - RNA, 19 nt, Human
uuaccuggacucaacuaaa

SEQ ID NO: 135879 - RNA, 22 nt, Human
ggcaaaguguauuugaucagaa

SEQ ID NO: 135880 - RNA, 19 nt, Human
uucccccagagcccugugu

SEQ ID NO: 135881 - RNA, 21 nt, Human
uguuggcagacuggagugcaa

SEQ ID NO: 135882 - RNA, 19 nt, Human
gacccggggaggccaggag

SEQ ID NO: 135883 - RNA, 27 nt, Human
ccagcuccugcugcugucccagucuug

SEQ ID NO: 135884 - RNA, 22 nt, Human
acuuauuaaaaggucaguauua

SEQ ID NO: 135885 - RNA, 22 nt, Human
cuccagccuuaguuuuuggagu

SEQ ID NO: 135886 - RNA, 21 nt, Human
ggccaagaagucccaagaccu

SEQ ID NO: 135887 - RNA, 23 nt, Human
gagagguugaggaugcacuggcc

SEQ ID NO: 135888 - RNA, 22 nt, Human
auguuaccuguuagugcugauc

SEQ ID NO: 135889 - RNA, 20 nt, Human
ccagccgccucgguucccgg

SEQ ID NO: 135890 - RNA, 21 nt, Human
uguuucuaagccuccuggacc

SEQ ID NO: 135891 - RNA, 26 nt, Human
uccuucccucauaccuugcccauucc

SEQ ID NO: 135892 - RNA, 27 nt, Human
uucugcacuugggcccuccucugggag

SEQ ID NO: 135893 - RNA, 28 nt, Human
gggacugaggcaguagagggaggcgaga

SEQ ID NO: 135894 - RNA, 30 nt, Human
cucuacagccaggcggccaggauucaacuc

SEQ ID NO: 135895 - RNA, 21 nt, Human
gcuuguuugugcuagaagaac

SEQ ID NO: 135896 - RNA, 19 nt, Human
ucggccgccucgcuaccag

SEQ ID NO: 135897 - RNA, 23 nt, Human
guaaaucacacaacagguuucua

SEQ ID NO: 135898 - RNA, 24 nt, Human
ggaugaagagaagauggacaccag

SEQ ID NO: 135899 - RNA, 27 nt, Human
cauuuaggaaagcagugcaguacucag

SEQ ID NO: 135900 - RNA, 22 nt, Human
ccaacuuccuguugggugcugu

SEQ ID NO: 135901 - RNA, 26 nt, Human
guagaaccuuuccagguucucuuaga

SEQ ID NO: 135902 - RNA, 22 nt, Human
cacccagacuggagugcagggg

SEQ ID NO: 135903 - RNA, 23 nt, Human
cugcugcucccggguccugcugc

SEQ ID NO: 135904 - RNA, 22 nt, Human
ugccuguaauccagcuacucag

SEQ ID NO: 135905 - RNA, 20 nt, Human
uuaaucuuaaaauuuuguga

SEQ ID NO: 135906 - RNA, 21 nt, Human
aggcggaggagguugcaguga

SEQ ID NO: 135907 - RNA, 27 nt, Human
cccaaguacugggauuacagcuuccau

SEQ ID NO: 135908 - RNA, 21 nt, Human
cagaguugguaccugcuuuaa

SEQ ID NO: 135909 - RNA, 21 nt, Human
uauucuguuucuuccuccuca

SEQ ID NO: 135910 - RNA, 29 nt, Human
gcugucgguuuuuaccugccuguugugga

SEQ ID NO: 135911 - RNA, 25 nt, Human
cuucugcugcugccauccuccagca

SEQ ID NO: 135912 - RNA, 19 nt, Human
gcagaucuuaaggucugag

SEQ ID NO: 135913 - RNA, 26 nt, Human
cuggauaccugugugucuccauaaaa

SEQ ID NO: 135914 - RNA, 22 nt, Human
cugcaagauacagagaauugcu

SEQ ID NO: 135915 - RNA, 22 nt, Human
auaucagcacacucauucuuug

SEQ ID NO: 135916 - RNA, 21 nt, Human
uucuccaaccaaaacaucaau

SEQ ID NO: 135917 - RNA, 27 nt, Human
uggccagagggcugucuggaccugggc

SEQ ID NO: 135918 - RNA, 27 nt, Human
cccuccuguccugggucuguguugcgg

SEQ ID NO: 135919 - RNA, 23 nt, Human
gacucagcuuggccaacuugggg

SEQ ID NO: 135920 - RNA, 22 nt, Human
gcccauucuucacucuguuuga

SEQ ID NO: 135921 - RNA, 21 nt, Human
cugcuccccugggcagcuguu

SEQ ID NO: 135922 - RNA, 24 nt, Human
gugguauauuucuaaaugauaugg

SEQ ID NO: 135923 - RNA, 23 nt, Human
gagcagcuucaggccucugccag

SEQ ID NO: 135924 - RNA, 22 nt, Human
cuacugcugccuuucauuuaua

SEQ ID NO: 135925 - RNA, 22 nt, Human
uccugacugcagggacucuguc

SEQ ID NO: 135926 - RNA, 23 nt, Human
gcgucucccuucucuccuggaca

SEQ ID NO: 135927 - RNA, 29 nt, Human
ccagccucuguggcccuguggccugcagg

SEQ ID NO: 135928 - RNA, 25 nt, Human
gcgaccugcuccagucuccaaagcc

SEQ ID NO: 135929 - RNA, 23 nt, Human
ugccuuacaauucacucauucca

SEQ ID NO: 135930 - RNA, 23 nt, Human
cccugcaggcaggcccaaguagg

SEQ ID NO: 135931 - RNA, 23 nt, Human
agccuggcuuggggguugguggg

SEQ ID NO: 135932 - RNA, 23 nt, Human
gggggcagaggcccaucuggccu

SEQ ID NO: 135933 - RNA, 24 nt, Human
gcaaggaugcugccuuuggucucu

SEQ ID NO: 135934 - RNA, 22 nt, Human
gaugcguggauaucuguguaua

SEQ ID NO: 135935 - RNA, 23 nt, Human
ucagcugagucaggggacaccuc

SEQ ID NO: 135936 - RNA, 25 nt, Human
aucaucugcaguucuuuuuguacac

SEQ ID NO: 135937 - RNA, 22 nt, Human
uaagaacaauaaaaguaauaug

SEQ ID NO: 135938 - RNA, 22 nt, Human
acagucuuguuuauacuuucug

SEQ ID NO: 135939 - RNA, 22 nt, Human
gcuccccaguggugggugcccc

SEQ ID NO: 135940 - RNA, 22 nt, Human
gguuggacauccugccccucac

SEQ ID NO: 135941 - RNA, 25 nt, Human
ggagcccuccaggccuuugcucucc

SEQ ID NO: 135942 - RNA, 27 nt, Human
acucaggauuacacugaaaguaauggc

SEQ ID NO: 135943 - RNA, 22 nt, Human
uuucagaaagugagaggaggga

SEQ ID NO: 135944 - RNA, 22 nt, Human
auguuccgcagucucacucuga

SEQ ID NO: 135945 - RNA, 21 nt, Human
ggaacacuaagcugugaugaa

SEQ ID NO: 135946 - RNA, 20 nt, Human
gggcgugccugucugcuccg

SEQ ID NO: 135947 - RNA, 24 nt, Human
cacuccucgcacuuccagccuugg

SEQ ID NO: 135948 - RNA, 23 nt, Human
cccuucagccaagccccaccugc

SEQ ID NO: 135949 - RNA, 21 nt, Human
gcugguugugugagagggcuu

SEQ ID NO: 135950 - RNA, 22 nt, Human
cugaggcucuuucugggccaag

SEQ ID NO: 135951 - RNA, 23 nt, Human
agacauccugauggggaggcaga

SEQ ID NO: 135952 - RNA, 24 nt, Human
uggccgaggcaggggcugggcuga

SEQ ID NO: 135953 - RNA, 22 nt, Human
cccccucuuacuuuuucucuug

SEQ ID NO: 135954 - RNA, 22 nt, Human
cucuggcccagcuuggauggcu

SEQ ID NO: 135955 - RNA, 21 nt, Human
caucaaauauuucuugcugcu

SEQ ID NO: 135956 - RNA, 18 nt, Human
ugggagcucccagaggaa

SEQ ID NO: 135957 - RNA, 23 nt, Human
cuugcagaagggagggggaaaca

SEQ ID NO: 135958 - RNA, 21 nt, Human
ucuucauuccuuuccagaaca

SEQ ID NO: 135959 - RNA, 26 nt, Human
uggacuuaagugagccucccgccuca

SEQ ID NO: 135960 - RNA, 22 nt, Human
aucuggaggaaauaggcagaaa

SEQ ID NO: 135961 - RNA, 25 nt, Human
ggaguguggagaggaaggaggcaga

SEQ ID NO: 135962 - RNA, 21 nt, Human
guuucuccucuuuccuccugc

SEQ ID NO: 135963 - RNA, 22 nt, Human
gauuuucuaauguugacuuuaa

SEQ ID NO: 135964 - RNA, 26 nt, Human
cgcagcccugggucugugcgccaacg

SEQ ID NO: 135965 - RNA, 21 nt, Human
gggauuuguugauucucucca

SEQ ID NO: 135966 - RNA, 22 nt, Human
ggccaggcucagagcugagaug

SEQ ID NO: 135967 - RNA, 21 nt, Human
ugcggcucuggggagcucuuu

SEQ ID NO: 135968 - RNA, 27 nt, Human
uuauuacaguuccacaucaaggccgag

SEQ ID NO: 135969 - RNA, 22 nt, Human
aacacaccagaggauguucucu

SEQ ID NO: 135970 - RNA, 23 nt, Human
ucugcugcugcccccaccucugc

SEQ ID NO: 135971 - RNA, 22 nt, Human
uucugucuccugcauacacucc

SEQ ID NO: 135972 - RNA, 20 nt, Human
cagaucacuuuuuaaacuca

SEQ ID NO: 135973 - RNA, 24 nt, Human
cuuacuaccucugaacaauacuca

SEQ ID NO: 135974 - RNA, 22 nt, Human
agcugauaaagacuuuagcuga

SEQ ID NO: 135975 - RNA, 22 nt, Human
ggcucacugcaaccuccaccuu

SEQ ID NO: 135976 - RNA, 22 nt, Human
ggcucacugcaacuuccaccuc

SEQ ID NO: 135977 - RNA, 21 nt, Human
ucccuuuaacccaagacccug

SEQ ID NO: 135978 - RNA, 21 nt, Human
auagugaauacugcuacagca

SEQ ID NO: 135979 - RNA, 19 nt, Human
acuauugaauuucucucca

SEQ ID NO: 135980 - RNA, 23 nt, Human
ggggugcugggccuggcgggcaa

SEQ ID NO: 135981 - RNA, 22 nt, Human
gcugucagccaccagggggcuc

SEQ ID NO: 135982 - RNA, 23 nt, Human
acguauuuauuugaaagcauuaa

SEQ ID NO: 135983 - RNA, 21 nt, Human
accgugacccccuccuccucc

SEQ ID NO: 135984 - RNA, 20 nt, Human
aaccagccacuaccucucug

SEQ ID NO: 135985 - RNA, 22 nt, Human
gucaucugagaaaccaacacau

SEQ ID NO: 135986 - RNA, 20 nt, Human
ggauacgagaacacuguaga

SEQ ID NO: 135987 - RNA, 19 nt, Human
cuuccaauuugccccacca

SEQ ID NO: 135988 - RNA, 25 nt, Human
agccugaggaagcaggagaguuccu

SEQ ID NO: 135989 - RNA, 22 nt, Human
gaagggagacauacuuaauacu

SEQ ID NO: 135990 - RNA, 20 nt, Human
ugggggccagccacggggac

SEQ ID NO: 135991 - RNA, 23 nt, Human
uugcccaaacucaggcagcuggg

SEQ ID NO: 135992 - RNA, 22 nt, Human
gagggagggcacguggagccgc

SEQ ID NO: 135993 - RNA, 22 nt, Human
agcauccuccccuguugagcgg

SEQ ID NO: 135994 - RNA, 22 nt, Human
cggacuccugggcucaagcaau

SEQ ID NO: 135995 - RNA, 26 nt, Human
ccuacuucacccauucaucuauccga

SEQ ID NO: 135996 - RNA, 27 nt, Human
ggaacagacccaaaucugaaccucuuu

SEQ ID NO: 135997 - RNA, 23 nt, Human
gucaccuccauuaccaaguagag

SEQ ID NO: 135998 - RNA, 24 nt, Human
cuugcugcugucaccaccaaacuc

SEQ ID NO: 135999 - RNA, 26 nt, Human
gcuggagaaagggaaguggaaggcag

SEQ ID NO: 136000 - RNA, 20 nt, Human
guccccucagcuaaggggcu

SEQ ID NO: 136001 - RNA, 23 nt, Human
guucuuagcuauccuuggcuuuc

SEQ ID NO: 136002 - RNA, 21 nt, Human
ggccagacagagaggcagcag

SEQ ID NO: 136003 - RNA, 24 nt, Human
cuagacgcuucuuauuuuaaucau

SEQ ID NO: 136004 - RNA, 21 nt, Human
ugcuccaccucugcagugauc

SEQ ID NO: 136005 - RNA, 26 nt, Human
guccaguuuuggaggcugaguucugg

SEQ ID NO: 136006 - RNA, 23 nt, Human
aaggcagcagagcggacugguga

SEQ ID NO: 136007 - RNA, 25 nt, Human
gccucccaggauggcgagcuccagu

SEQ ID NO: 136008 - RNA, 21 nt, Human
ucuguucugcugggaguucua

SEQ ID NO: 136009 - RNA, 22 nt, Human
acagggcagcauggaaguuuaa

SEQ ID NO: 136010 - RNA, 25 nt, Human
cccauaccccacaccugcccagcuc

SEQ ID NO: 136011 - RNA, 20 nt, Human
aggaacuuauuauagcuaau

SEQ ID NO: 136012 - RNA, 27 nt, Human
agacggccagccccacacuucgcuuca

SEQ ID NO: 136013 - RNA, 25 nt, Human
ccuggacgguggcccccagccgccc

SEQ ID NO: 136014 - RNA, 21 nt, Human
aacuauucuguuccacaccca

SEQ ID NO: 136015 - RNA, 20 nt, Human
accuuucuaggaucugggaa

SEQ ID NO: 136016 - RNA, 23 nt, Human
ucuaggcguuuuacacugagauu

SEQ ID NO: 136017 - RNA, 16 nt, Human
uaccucucccaccucu

SEQ ID NO: 136018 - RNA, 23 nt, Human
aucgugccauugcauuccagccu

SEQ ID NO: 136019 - RNA, 17 nt, Human
cuuguaaaaauguuuug

SEQ ID NO: 136020 - RNA, 27 nt, Human
ccagcuguaguuaauuucagugccuua

SEQ ID NO: 136021 - RNA, 24 nt, Human
uggggaccccaaggcuuucugggg

SEQ ID NO: 136022 - RNA, 18 nt, Human
cucuucuuccucuucuuu

SEQ ID NO: 136023 - RNA, 21 nt, Human
augccucaccaauuugcccgu

SEQ ID NO: 136024 - RNA, 23 nt, Human
cagccucuuucugucccuucugu

SEQ ID NO: 136025 - RNA, 21 nt, Human
ugugagccacaccuccuagcu

SEQ ID NO: 136026 - RNA, 20 nt, Human
uuucauguuaaagagccgug

SEQ ID NO: 136027 - RNA, 22 nt, Human
aggucuccucaacacugggcug

SEQ ID NO: 136028 - RNA, 22 nt, Human
gcccacgcuggagugcagugag

SEQ ID NO: 136029 - RNA, 21 nt, Human
gccuucugccaccagccccuc

SEQ ID NO: 136030 - RNA, 27 nt, Human
cccagcaccaccucauacuaagaauuc

SEQ ID NO: 136031 - RNA, 20 nt, Human
cagccuaucccauugcaagg

SEQ ID NO: 136032 - RNA, 23 nt, Human
agaaccuccacucccuccgcugc

SEQ ID NO: 136033 - RNA, 20 nt, Human
gagcuagggugggggcugug

SEQ ID NO: 136034 - RNA, 22 nt, Human
ucugcuccugucccccgcucuc

SEQ ID NO: 136035 - RNA, 22 nt, Human
ccaaguagcuggaauuacaggc

SEQ ID NO: 136036 - RNA, 22 nt, Human
ccaaguagcugggauuacagac

SEQ ID NO: 136037 - RNA, 19 nt, Human
ugagcaccuggggauuuua

SEQ ID NO: 136038 - RNA, 22 nt, Human
caugaggucaggaguuccagac

SEQ ID NO: 136039 - RNA, 18 nt, Human
ucaugugaccacucuguc

SEQ ID NO: 136040 - RNA, 20 nt, Human
acauauauaugcacauguau

SEQ ID NO: 136041 - RNA, 20 nt, Human
gagccagacugucucaaaua

SEQ ID NO: 136042 - RNA, 23 nt, Human
gaagagucugaugaaaggccggg

SEQ ID NO: 136043 - RNA, 19 nt, Human
cccuugccuuccugccuag

SEQ ID NO: 136044 - RNA, 23 nt, Human
auuuuaagcaaaagcauccaaga

SEQ ID NO: 136045 - RNA, 25 nt, Human
ucagcccuggcccucugccugcucc

SEQ ID NO: 136046 - RNA, 22 nt, Human
ccuccucccccuccuccucacc

SEQ ID NO: 136047 - RNA, 22 nt, Human
cucaagccauccuucugccuca

SEQ ID NO: 136048 - RNA, 25 nt, Human
ugagaagccaccaaaaauauugaaa

SEQ ID NO: 136049 - RNA, 21 nt, Human
agcucuauuccugacacuacc

SEQ ID NO: 136050 - RNA, 27 nt, Human
ggcacccuggcuauagcuuauacagua

SEQ ID NO: 136051 - RNA, 24 nt, Human
ugucucccgccacccacaccagcu

SEQ ID NO: 136052 - RNA, 25 nt, Human
ccuacuuccccuuccccggggcuga

SEQ ID NO: 136053 - RNA, 19 nt, Human
cauucccucuuauccaucu

SEQ ID NO: 136054 - RNA, 22 nt, Human
agccucccaaguaacugggauu

SEQ ID NO: 136055 - RNA, 19 nt, Human
uuugcugcccccaccccuc

SEQ ID NO: 136056 - RNA, 22 nt, Human
uacacaaaauuacuuuguggua

SEQ ID NO: 136057 - RNA, 22 nt, Human
agagaaacagauaagugaauug

SEQ ID NO: 136058 - RNA, 20 nt, Human
ucugcccucugcauccucug

SEQ ID NO: 136059 - RNA, 23 nt, Human
cauuuugcccugcuucucucagg

SEQ ID NO: 136060 - RNA, 22 nt, Human
aggcugagguaggagaauugcu

SEQ ID NO: 136061 - RNA, 27 nt, Human
ggccagauaauucuuuguuguggggcu

SEQ ID NO: 136062 - RNA, 22 nt, Human
cccaguaaugcugcugccugac

SEQ ID NO: 136063 - RNA, 22 nt, Human
gcucacugcaacgucugccucc

SEQ ID NO: 136064 - RNA, 21 nt, Human
aucgcccaggcuggagugcaa

SEQ ID NO: 136065 - RNA, 25 nt, Human
caguugaagugagagaguuugguga

SEQ ID NO: 136066 - RNA, 21 nt, Human
cuuuucuccccucucuggguu

SEQ ID NO: 136067 - RNA, 21 nt, Human
guacuuuugcaguucuuccca

SEQ ID NO: 136068 - RNA, 21 nt, Human
cugcuugguguucccugagga

SEQ ID NO: 136069 - RNA, 22 nt, Human
cagcucuucaccgaaauguugu

SEQ ID NO: 136070 - RNA, 21 nt, Human
cuuugucccuuuauuuauuuu

SEQ ID NO: 136071 - RNA, 22 nt, Human
uuuggaauuucugagucauuua

SEQ ID NO: 136072 - RNA, 25 nt, Human
ggcgguacuaguucagacacuuugg

SEQ ID NO: 136073 - RNA, 22 nt, Human
aacucagcaucaaaauauuuca

SEQ ID NO: 136074 - RNA, 22 nt, Human
gaaccccaggcuggagugcagu

SEQ ID NO: 136075 - RNA, 20 nt, Human
caaauucagccuacugccuc

SEQ ID NO: 136076 - RNA, 32 nt, Human
caugccuuaugcaagagaccucagucccccgg

SEQ ID NO: 136077 - RNA, 28 nt, Human
acuguaccucgugccugcugcggcugcg

SEQ ID NO: 136078 - RNA, 20 nt, Human
caagggggaugcuguggaaa

SEQ ID NO: 136079 - RNA, 26 nt, Human
caucccgguacuggcuggagucugug

SEQ ID NO: 136080 - RNA, 24 nt, Human
uuccugcacacuaaauagcuagca

SEQ ID NO: 136081 - RNA, 26 nt, Human
cacugcacuccagccugggcaacaga

SEQ ID NO: 136082 - RNA, 26 nt, Human
ccuuucucuucccuguucuuguaaca

SEQ ID NO: 136083 - RNA, 24 nt, Human
cucuucugcugaccucagauacca

SEQ ID NO: 136084 - RNA, 23 nt, Human
cccuauuugaaguuucaggauuu

SEQ ID NO: 136085 - RNA, 24 nt, Human
acugcgaccuccuucccuccuggg

SEQ ID NO: 136086 - RNA, 27 nt, Human
uucucucugugcucuugcauucucuca

SEQ ID NO: 136087 - RNA, 23 nt, Human
cucugcaccugguauauggguca

SEQ ID NO: 136088 - RNA, 22 nt, Human
acccuguuucuuauuuuucuuc

SEQ ID NO: 136089 - RNA, 21 nt, Human
agcccauucucucuccugucc

SEQ ID NO: 136090 - RNA, 24 nt, Human
uugcuuuggaaauccucuaggagg

SEQ ID NO: 136091 - RNA, 22 nt, Human
ccaguggggacagggaggggga

SEQ ID NO: 136092 - RNA, 21 nt, Human
aggugggcagcuguggcagag

SEQ ID NO: 136093 - RNA, 27 nt, Human
agagccaaaaucagagcuggaaccuga

SEQ ID NO: 136094 - RNA, 20 nt, Human
caaaccugucacuuugguca

SEQ ID NO: 136095 - RNA, 29 nt, Human
agcggcacugugccuaccucuagccaaga

SEQ ID NO: 136096 - RNA, 21 nt, Human
caaacaauuuaaaaaugagug

SEQ ID NO: 136097 - RNA, 27 nt, Human
gcagaauugggagggacuuuguggaga

SEQ ID NO: 136098 - RNA, 27 nt, Human
cccaccccuucacaguguugauugcua

SEQ ID NO: 136099 - RNA, 20 nt, Human
aguggaggcagcggggcagg

SEQ ID NO: 136100 - RNA, 20 nt, Human
cauacacuggacacugcagg

SEQ ID NO: 136101 - RNA, 17 nt, Human
ggcagcgacccaccucc

SEQ ID NO: 136102 - RNA, 25 nt, Human
uugccaucuuuuuguuuucuuugaa

SEQ ID NO: 136103 - RNA, 29 nt, Human
acugcuucauugccuucucugauugccuu

SEQ ID NO: 136104 - RNA, 22 nt, Human
ugucuauaaucccagcacuuug

SEQ ID NO: 136105 - RNA, 26 nt, Human
ccucaagggcuucagcaccgcgccca

SEQ ID NO: 136106 - RNA, 26 nt, Human
uuuuaagucuucgaacagucuccuuu

SEQ ID NO: 136107 - RNA, 21 nt, Human
cgccucggggagucucaccca

SEQ ID NO: 136108 - RNA, 27 nt, Human
aucccaggugauuuuaucaauuccagu

SEQ ID NO: 136109 - RNA, 27 nt, Human
ccagaaaccacacauucacucaauaug

SEQ ID NO: 136110 - RNA, 26 nt, Human
cccaucaggccacacugcugccaccu

SEQ ID NO: 136111 - RNA, 27 nt, Human
cuccagcccuaagugccuggacgggau

SEQ ID NO: 136112 - RNA, 22 nt, Human
uguuuuuaaucuguggcucuug

SEQ ID NO: 136113 - RNA, 26 nt, Human
cuggguuaggaacaguuguacuuuca

SEQ ID NO: 136114 - RNA, 26 nt, Human
ucaguagagugaggugauccuuagca

SEQ ID NO: 136115 - RNA, 20 nt, Human
ggaaggcaggggauuuagga

SEQ ID NO: 136116 - RNA, 22 nt, Human
caacagagccgguucucagggc

SEQ ID NO: 136117 - RNA, 25 nt, Human
ccauauuugcccagaagaggcaguu

SEQ ID NO: 136118 - RNA, 22 nt, Human
acccucuuaagcagcaccagaa

SEQ ID NO: 136119 - RNA, 21 nt, Human
gaauugucuguguuuauuguu

SEQ ID NO: 136120 - RNA, 14 nt, Human
uaccccuuacccca

SEQ ID NO: 136121 - RNA, 21 nt, Human
cauucacaaccuccauuuuca

SEQ ID NO: 136122 - RNA, 24 nt, Human
guggucccauuguuaacucagccu

SEQ ID NO: 136123 - RNA, 21 nt, Human
accucccuuuuuauuucuuga

SEQ ID NO: 136124 - RNA, 20 nt, Human
gugcagcugccgaaaguguc

SEQ ID NO: 136125 - RNA, 21 nt, Human
auugaagagagaaaugacagg

SEQ ID NO: 136126 - RNA, 22 nt, Human
uuuggaguccccucaccuccuc

SEQ ID NO: 136127 - RNA, 22 nt, Human
cccagccuguguccacagugcu

SEQ ID NO: 136128 - RNA, 25 nt, Human
ccuaccuuccuguaacgacccccgg

SEQ ID NO: 136129 - RNA, 21 nt, Human
ucuaguccugcuccuugugcu

SEQ ID NO: 136130 - RNA, 27 nt, Human
cgcagcccuggcccaggaaggcaggag

SEQ ID NO: 136131 - RNA, 19 nt, Human
uggcaucuucgcuucuccu

SEQ ID NO: 136132 - RNA, 18 nt, Human
guauuuucacugucuuca

SEQ ID NO: 136133 - RNA, 24 nt, Human
ugacauuccaggcccaugagggga

SEQ ID NO: 136134 - RNA, 18 nt, Human
agcguauucuguuuuucu

SEQ ID NO: 136135 - RNA, 23 nt, Human
uuuauauuuuucuuucucuuuca

SEQ ID NO: 136136 - RNA, 25 nt, Human
cccugccacugccacaacccccgau

SEQ ID NO: 136137 - RNA, 26 nt, Human
ggaggccacaguccuuccuggggcau

SEQ ID NO: 136138 - RNA, 22 nt, Human
gggggagaagagggcaccccuc

SEQ ID NO: 136139 - RNA, 24 nt, Human
aucauggggcaugauuauagaggu

SEQ ID NO: 136140 - RNA, 21 nt, Human
uacacuuaugcauugccaaag

SEQ ID NO: 136141 - RNA, 20 nt, Human
cccaccccagacggccacca

SEQ ID NO: 136142 - RNA, 21 nt, Human
uuagauuuugaagaugagcau

SEQ ID NO: 136143 - RNA, 19 nt, Human
gcugcacucuggcugggga

SEQ ID NO: 136144 - RNA, 26 nt, Human
aacauuuuccugcuugucuuagaaga

SEQ ID NO: 136145 - RNA, 22 nt, Human
caugcuuguaaucccagcacuu

SEQ ID NO: 136146 - RNA, 22 nt, Human
caugccuguaaucccagcacuc

SEQ ID NO: 136147 - RNA, 22 nt, Human
caugccuguaaucucagcacuu

SEQ ID NO: 136148 - RNA, 22 nt, Human
gucacucaggcuggagcacagu

SEQ ID NO: 136149 - RNA, 21 nt, Human
ccaagagaaaacaccacacug

SEQ ID NO: 136150 - RNA, 24 nt, Human
auugcgcccccugcacuccagccu

SEQ ID NO: 136151 - RNA, 22 nt, Human
guaaaugcaggucucuugguau

SEQ ID NO: 136152 - RNA, 23 nt, Human
accaucaacgacuuucucuucca

SEQ ID NO: 136153 - RNA, 21 nt, Human
ugucaaugccaggauuucuca

SEQ ID NO: 136154 - RNA, 20 nt, Human
ugaccaagaucacuuuaguc

SEQ ID NO: 136155 - RNA, 26 nt, Human
gaggccaaaggggcuggggaggcagg

SEQ ID NO: 136156 - RNA, 27 nt, Human
agccuuugcgaccagagcccuuuucaa

SEQ ID NO: 136157 - RNA, 26 nt, Human
gauacuuguuuguuucuuucuuucuu

SEQ ID NO: 136158 - RNA, 19 nt, Human
uggcuuucagccucugggu

SEQ ID NO: 136159 - RNA, 21 nt, Human
aacuucuuagcgcaagcaaug

SEQ ID NO: 136160 - RNA, 21 nt, Human
uauuaauggugaaaacacugu

SEQ ID NO: 136161 - RNA, 17 nt, Human
guccccucuccuagcca

SEQ ID NO: 136162 - RNA, 21 nt, Human
ccaaagugcugggauuaaggc

SEQ ID NO: 136163 - RNA, 24 nt, Human
auagaauagcauguuguagauaca

SEQ ID NO: 136164 - RNA, 21 nt, Human
gagccagcugauaauauuuaa

SEQ ID NO: 136165 - RNA, 26 nt, Human
cauucaggcugugcugggaagaagag

SEQ ID NO: 136166 - RNA, 23 nt, Human
agcacagccagacuugcuuccug

SEQ ID NO: 136167 - RNA, 24 nt, Human
cgccgucggcucuaccugcgugcu

SEQ ID NO: 136168 - RNA, 27 nt, Human
ucccuccagagacauggauccccagac

SEQ ID NO: 136169 - RNA, 21 nt, Human
cuccagggggccugccuuucc

SEQ ID NO: 136170 - RNA, 27 nt, Human
acucuuaucuuuccccacuucauucca

SEQ ID NO: 136171 - RNA, 25 nt, Human
caaggguugagagccaguggcgggu

SEQ ID NO: 136172 - RNA, 22 nt, Human
cuggcaguggcuucagagagga

SEQ ID NO: 136173 - RNA, 27 nt, Human
cacagccgcacgcacugccguguucuc

SEQ ID NO: 136174 - RNA, 23 nt, Human
caacuccugggcucaaggcaucc

SEQ ID NO: 136175 - RNA, 23 nt, Human
gaguuauuuaaccacuauguuca

SEQ ID NO: 136176 - RNA, 20 nt, Human
cgcugcuuguucuguccccu

SEQ ID NO: 136177 - RNA, 24 nt, Human
gccccgcccccugagccuggguag

SEQ ID NO: 136178 - RNA, 27 nt, Human
cgccgccgucggcugggcaccaugaac

SEQ ID NO: 136179 - RNA, 28 nt, Human
ccugcggaagccuggccugcuggggaug

SEQ ID NO: 136180 - RNA, 26 nt, Human
ucuuauaauaaaaaggaaggacagga

SEQ ID NO: 136181 - RNA, 23 nt, Human
aucaaauuacauagcaaugcuga

SEQ ID NO: 136182 - RNA, 21 nt, Human
ucacaugcuugaucaguuaca

SEQ ID NO: 136183 - RNA, 19 nt, Human
agaagaaagcucucacuua

SEQ ID NO: 136184 - RNA, 22 nt, Human
acuuguuuguaaagcacuuuga

SEQ ID NO: 136185 - RNA, 20 nt, Human
gcugucucuccccugucccc

SEQ ID NO: 136186 - RNA, 24 nt, Human
aaucaggcugagcugaauguagug

SEQ ID NO: 136187 - RNA, 19 nt, Human
aaaguggcgugggagccag

SEQ ID NO: 136188 - RNA, 19 nt, Human
gggagagagaacuggccag

SEQ ID NO: 136189 - RNA, 25 nt, Human
cucucucuucgggcguguuaagaca

SEQ ID NO: 136190 - RNA, 23 nt, Human
uaggaagggauuggcaucggcug

SEQ ID NO: 136191 - RNA, 21 nt, Human
uuagguagcacagcacuuugg

SEQ ID NO: 136192 - RNA, 20 nt, Human
ccuccccacuguuuauuuau

SEQ ID NO: 136193 - RNA, 22 nt, Human
auuuuuucauaaucaaagguca

SEQ ID NO: 136194 - RNA, 22 nt, Human
cgggaggcggagcuugcaguga

SEQ ID NO: 136195 - RNA, 22 nt, Human
cgggcggcggagauugcaguga

SEQ ID NO: 136196 - RNA, 19 nt, Human
uguuguccucaagcauggu

SEQ ID NO: 136197 - RNA, 27 nt, Human
cacauccucaaacuuuguuaaacauaa

SEQ ID NO: 136198 - RNA, 23 nt, Human
cuacauaguccaaacaaaaaaga

SEQ ID NO: 136199 - RNA, 23 nt, Human
caaaacuucuggcaaggccaggc

SEQ ID NO: 136200 - RNA, 27 nt, Human
aaaucuuagcuguuuuuuauguuaaca

SEQ ID NO: 136201 - RNA, 26 nt, Human
gcggagguggaggugcagggucaacu

SEQ ID NO: 136202 - RNA, 26 nt, Human
cgcccaccuggcggaaagcaccacgg

SEQ ID NO: 136203 - RNA, 25 nt, Human
cuggagcugaggcugugggcggcug

SEQ ID NO: 136204 - RNA, 26 nt, Human
cuugcucuccacuuuucaaguggguc

SEQ ID NO: 136205 - RNA, 21 nt, Human
gcucagcccuggugggcagag

SEQ ID NO: 136206 - RNA, 23 nt, Human
ucugagcugcagccuggcugguc

SEQ ID NO: 136207 - RNA, 22 nt, Human
ggucucaaacuccuaaccuugu

SEQ ID NO: 136208 - RNA, 21 nt, Human
ggcaggagaggggagaacccc

SEQ ID NO: 136209 - RNA, 22 nt, Human
uuccugagccuggcaccaggag

SEQ ID NO: 136210 - RNA, 19 nt, Human
gcuggcaaccugccuccca

SEQ ID NO: 136211 - RNA, 21 nt, Human
ucacacaacucagccuggcug

SEQ ID NO: 136212 - RNA, 21 nt, Human
accuuaggccuuccucucucc

SEQ ID NO: 136213 - RNA, 27 nt, Human
cuuaccucucagccuuagcucucccaa

SEQ ID NO: 136214 - RNA, 22 nt, Human
aggcccgcgcgccugagcccag

SEQ ID NO: 136215 - RNA, 22 nt, Human
gucucaaacuccugaccugagg

SEQ ID NO: 136216 - RNA, 22 nt, Human
ccacaggguccuguuguuuugu

SEQ ID NO: 136217 - RNA, 21 nt, Human
uccugcucuguccucaucccc

SEQ ID NO: 136218 - RNA, 22 nt, Human
cuucccuucuacacaccugagg

SEQ ID NO: 136219 - RNA, 27 nt, Human
agagacacggucacugauucacaccca

SEQ ID NO: 136220 - RNA, 25 nt, Human
cgugagccaucaaugugcucugguc

SEQ ID NO: 136221 - RNA, 24 nt, Human
augccagagggccagcaggcuccu

SEQ ID NO: 136222 - RNA, 26 nt, Human
guguuuaaaaaaugagcuuccauuaa

SEQ ID NO: 136223 - RNA, 22 nt, Human
uacaucuucugugugaucuugg

SEQ ID NO: 136224 - RNA, 22 nt, Human
aaccugggucagagugaaagga

SEQ ID NO: 136225 - RNA, 27 nt, Human
ugggagguggagggacaggcucagccu

SEQ ID NO: 136226 - RNA, 17 nt, Human
acuagggaaaugccuuu

SEQ ID NO: 136227 - RNA, 23 nt, Human
cgugggucucugcggcugcggcg

SEQ ID NO: 136228 - RNA, 27 nt, Human
cucagcuuuuuguaugucuuuguaugc

SEQ ID NO: 136229 - RNA, 23 nt, Human
gaaugguauggaaucugagggaa

SEQ ID NO: 136230 - RNA, 28 nt, Human
gagcuucggaccaagaucaaaccaaaca

SEQ ID NO: 136231 - RNA, 25 nt, Human
uucauuuaaaggcuacuauucaucc

SEQ ID NO: 136232 - RNA, 27 nt, Human
uuucuacuagcaccuaucauaaugguc

SEQ ID NO: 136233 - RNA, 26 nt, Human
ucacccaggcuggagugcaaugggca

SEQ ID NO: 136234 - RNA, 26 nt, Human
aaaauacaaaaaauuagccgagcacg

SEQ ID NO: 136235 - RNA, 19 nt, Human
agguuuugccucagcugcu

SEQ ID NO: 136236 - RNA, 20 nt, Human
ggccuuucacuccaguucug

SEQ ID NO: 136237 - RNA, 22 nt, Human
cugagcagagagcagcagcagc

SEQ ID NO: 136238 - RNA, 27 nt, Human
gcccugugcacucagcacucauaggau

SEQ ID NO: 136239 - RNA, 19 nt, Human
ccaggaggaggaggcugca

SEQ ID NO: 136240 - RNA, 19 nt, Human
agaacaauguuuaugcuau

SEQ ID NO: 136241 - RNA, 22 nt, Human
gacuucugcuuuccacaccugc

SEQ ID NO: 136242 - RNA, 21 nt, Human
cagauggaaaagggaggcagg

SEQ ID NO: 136243 - RNA, 24 nt, Human
uguggagucgggacuggagcugcu

SEQ ID NO: 136244 - RNA, 20 nt, Human
uuccuucaggguuuaauaga

SEQ ID NO: 136245 - RNA, 23 nt, Human
gggcagcuggaguggugcucugg

SEQ ID NO: 136246 - RNA, 32 nt, Human
cugccgauucugucuguggcuucuucccugcc

SEQ ID NO: 136247 - RNA, 21 nt, Human
ggaaggcacagggagaaggga

SEQ ID NO: 136248 - RNA, 27 nt, Human
uccacaaacccuccgugcacucagccg

SEQ ID NO: 136249 - RNA, 19 nt, Human
auggaucugguugugcaua

SEQ ID NO: 136250 - RNA, 19 nt, Human
caacaagccccacagcccc

SEQ ID NO: 136251 - RNA, 22 nt, Human
aaagcagcuggugugggaggaa

SEQ ID NO: 136252 - RNA, 26 nt, Human
gcugcacuugugcccccagauguuuc

SEQ ID NO: 136253 - RNA, 26 nt, Human
ccugggcaacagagcaagacccaucu

SEQ ID NO: 136254 - RNA, 20 nt, Human
aaguggugcgccaagcacag

SEQ ID NO: 136255 - RNA, 26 nt, Human
caucccucguccccuaucgcaucuug

SEQ ID NO: 136256 - RNA, 22 nt, Human
gggcaguuugacuucagcacug

SEQ ID NO: 136257 - RNA, 32 nt, Human; identical to SEQ ID NO: 6082

SEQ ID NO: 136258 - RNA, 22 nt, Human
cauagauucucugcagcuuucu

SEQ ID NO: 136259 - RNA, 20 nt, Human
gccaggcuggagugcagugg

SEQ ID NO: 136260 - RNA, 27 nt, Human
ugcagccugcagcaagugcuuccgucu

SEQ ID NO: 136261 - RNA, 27 nt, Human
gccgaguuaaagaggagaaggaaaaca

SEQ ID NO: 136262 - RNA, 22 nt, Human
ccgauacacaucaugugccagu

SEQ ID NO: 136263 - RNA, 23 nt, Human
cuccagccucgaccucccgaggc

SEQ ID NO: 136264 - RNA, 20 nt, Human
cacaagucccuguggacgga

SEQ ID NO: 136265 - RNA, 22 nt, Human
aguacauaguuugauccauucc

SEQ ID NO: 136266 - RNA, 22 nt, Human
ucacugcagccucaaacuccug

SEQ ID NO: 136267 - RNA, 22 nt, Human
ucacugcagccuugaacuccca

SEQ ID NO: 136268 - RNA, 22 nt, Human
cucaggugauccaccugccuca

SEQ ID NO: 136269 - RNA, 23 nt, Human
acuguguguacauauauauucua

SEQ ID NO: 136270 - RNA, 22 nt, Human
aauaacuguguacuguucggaa

SEQ ID NO: 136271 - RNA, 20 nt, Human
ucccagcagcucaaccuacc

SEQ ID NO: 136272 - RNA, 27 nt, Human
gaggacuguccucccacagacccugca

SEQ ID NO: 136273 - RNA, 21 nt, Human
aggguggaaggaugggauggg

SEQ ID NO: 136274 - RNA, 26 nt, Human
gggggucagaagagagggugaguccu

SEQ ID NO: 136275 - RNA, 22 nt, Human
cacguugaaaaucaacccaaua

SEQ ID NO: 136276 - RNA, 26 nt, Human
cccugcagcaaagaagcccgagacug

SEQ ID NO: 136277 - RNA, 20 nt, Human
guguacuucaccucuuggcu

SEQ ID NO: 136278 - RNA, 32 nt, Human
ggcgaucggagugggccuuuucuuucuuuuug

SEQ ID NO: 136279 - RNA, 21 nt, Human
ggggcagcugccccaucccuc

SEQ ID NO: 136280 - RNA, 24 nt, Human
gccuggcccaggcuaauuuuuuga

SEQ ID NO: 136281 - RNA, 22 nt, Human
cgcugcuucuugaucuaggcaa

SEQ ID NO: 136282 - RNA, 21 nt, Human
ucucaccagcucagccccggc

SEQ ID NO: 136283 - RNA, 27 nt, Human
agaaaacaaaacugccaguuugugcuu

SEQ ID NO: 136284 - RNA, 19 nt, Human
uauuucugugccagacaca

SEQ ID NO: 136285 - RNA, 27 nt, Human
ggucuuaaacuccuaaccucaggugau

SEQ ID NO: 136286 - RNA, 22 nt, Human
cugagaucacgucauugcacuc

SEQ ID NO: 136287 - RNA, 22 nt, Human
ccgagaucaugccauugcauuc

SEQ ID NO: 136288 - RNA, 23 nt, Human
ggucaccuuucaaggacccagaa

SEQ ID NO: 136289 - RNA, 26 nt, Human
ugcugugagcucuggccgcugccuuc

SEQ ID NO: 136290 - RNA, 20 nt, Human
gcugggaggaggaagaccau

SEQ ID NO: 136291 - RNA, 22 nt, Human
accugaaaucuuagcacuucgg

SEQ ID NO: 136292 - RNA, 21 nt, Human
ugaagacaagccaccaggacu

SEQ ID NO: 136293 - RNA, 22 nt, Human
ggucuaucuuuaauuuguuauc

SEQ ID NO: 136294 - RNA, 25 nt, Human
uuguuuucuaaguaauugcugccuc

SEQ ID NO: 136295 - RNA, 27 nt, Human
gcgcagccacagaaggcgccgaggcuc

SEQ ID NO: 136296 - RNA, 24 nt, Human
cacuucacuuucuucaaagccaca

SEQ ID NO: 136297 - RNA, 22 nt, Human
ccaaagugcugggauuaaaggu

SEQ ID NO: 136298 - RNA, 22 nt, Human
accugccuggccgggcguggug

SEQ ID NO: 136299 - RNA, 20 nt, Human
cagaugucaugugaaaacgc

SEQ ID NO: 136300 - RNA, 20 nt, Human
gggauucugccucagguacu

SEQ ID NO: 136301 - RNA, 21 nt, Human
cuuccaguugagguguuuuau

SEQ ID NO: 136302 - RNA, 22 nt, Human
ccaaagcgcugggauuauaggu

SEQ ID NO: 136303 - RNA, 25 nt, Human
cuccugagccuucaggagccugcac

SEQ ID NO: 136304 - RNA, 20 nt, Human
uacuaaauaaacaucugauc

SEQ ID NO: 136305 - RNA, 27 nt, Human
ggaggucaagaugggaggauugcuuga

SEQ ID NO: 136306 - RNA, 25 nt, Human
cuugcaccuucuuuuggggaaacgg

SEQ ID NO: 136307 - RNA, 21 nt, Human
agugggugaucuuggcucacu

SEQ ID NO: 136308 - RNA, 26 nt, Human
acugcacuccagcuugggcaacaggg

SEQ ID NO: 136309 - RNA, 18 nt, Human
agagcaacucagcaggac

SEQ ID NO: 136310 - RNA, 20 nt, Human
auuauucuaaaucaccagaa

SEQ ID NO: 136311 - RNA, 24 nt, Human
aauguuuuaguuauugaaacuaca

SEQ ID NO: 136312 - RNA, 20 nt, Human
gaggggaagaggggccccga

SEQ ID NO: 136313 - RNA, 27 nt, Human
ggucucgaacuccugaacucaagugau

SEQ ID NO: 136314 - RNA, 22 nt, Human
cgguguucuucuucucuucucu

SEQ ID NO: 136315 - RNA, 22 nt, Human
agggauugaaggggguaccuua

SEQ ID NO: 136316 - RNA, 20 nt, Human
ccugagcucccucaucccag

SEQ ID NO: 136317 - RNA, 27 nt, Human
cuggagaucuaauacaggcuugaaagc

SEQ ID NO: 136318 - RNA, 20 nt, Human
cuggugcagauucaagcucc

SEQ ID NO: 136319 - RNA, 22 nt, Human
ugugagucauuauguagcuguc

SEQ ID NO: 136320 - RNA, 23 nt, Human
uggagacaaaacaguguuuguaa

SEQ ID NO: 136321 - RNA, 20 nt, Human
uugccucccugagugcagag

SEQ ID NO: 136322 - RNA, 26 nt, Human
gagaccaagagcaggggauagaagcc

SEQ ID NO: 136323 - RNA, 21 nt, Human
ggauggccacagaaggggcag

SEQ ID NO: 136324 - RNA, 22 nt, Human
ggaggcugaaguggguggauca

SEQ ID NO: 136325 - RNA, 24 nt, Human
ccucucccauccuuuucugcucca

SEQ ID NO: 136326 - RNA, 21 nt, Human
uagaucuuuauagagugugaa

SEQ ID NO: 136327 - RNA, 21 nt, Human
cuucaguguggagaaaucuca

SEQ ID NO: 136328 - RNA, 19 nt, Human
gacagcucaccuagcugca

SEQ ID NO: 136329 - RNA, 25 nt, Human
gcugccuccguggucccugccuggc

SEQ ID NO: 136330 - RNA, 21 nt, Human
ugaaacugguguauggaagac

SEQ ID NO: 136331 - RNA, 21 nt, Human
ugacauccuuucaagaagucc

SEQ ID NO: 136332 - RNA, 21 nt, Human
uucauuuucacauguuacuca

SEQ ID NO: 136333 - RNA, 23 nt, Human
uccuucaguccauucccuuaggc

SEQ ID NO: 136334 - RNA, 27 nt, Human
cuggccuggccccucuguccuguggaa

SEQ ID NO: 136335 - RNA, 23 nt, Human
ucugggcuuaauuuucucuuggg

SEQ ID NO: 136336 - RNA, 26 nt, Human
ccguaccagccgcgucucucaggaca

SEQ ID NO: 136337 - RNA, 28 nt, Human
gggagccuuggcccugcucacagagaga

SEQ ID NO: 136338 - RNA, 19 nt, Human
acucauuccauguggaaca

SEQ ID NO: 136339 - RNA, 23 nt, Human
cccagcaccauuuaugagucuca

SEQ ID NO: 136340 - RNA, 27 nt, Human
ccuguucugggggucugucucuuuucu

SEQ ID NO: 136341 - RNA, 27 nt, Human
ccgggaggcggagguugcgacccaaag

SEQ ID NO: 136342 - RNA, 22 nt, Human
agagaaguguggggaagagaua

SEQ ID NO: 136343 - RNA, 24 nt, Human
cuucucuccucagacuucaagggc

SEQ ID NO: 136344 - RNA, 17 nt, Human
aucaaaagcugcugcua

SEQ ID NO: 136345 - RNA, 22 nt, Human
ugcagcgagcugagaucaugcc

SEQ ID NO: 136346 - RNA, 22 nt, Human
aaggcauuuugaugaugcuuuu

SEQ ID NO: 136347 - RNA, 23 nt, Human
uggagaacauuuuauucuugaca

SEQ ID NO: 136348 - RNA, 22 nt, Human
aggcagcucuguucauggcguu

SEQ ID NO: 136349 - RNA, 23 nt, Human
ucugucugcucuuagcugucucc

SEQ ID NO: 136350 - RNA, 21 nt, Human
uucuugcugcucuuuuuccca

SEQ ID NO: 136351 - RNA, 25 nt, Human
ucucagcccggccgcaccaccuggg

SEQ ID NO: 136352 - RNA, 22 nt, Human
gcacccacugcauuugcagccu

SEQ ID NO: 136353 - RNA, 26 nt, Human
cccacccuucucucucgagggaucua

SEQ ID NO: 136354 - RNA, 24 nt, Human
accuuccucuccauuuugcuguga

SEQ ID NO: 136355 - RNA, 20 nt, Human
gagaacaucuauagugcuac

SEQ ID NO: 136356 - RNA, 22 nt, Human
aauaauucuuucaagaagauca

SEQ ID NO: 136357 - RNA, 25 nt, Human
uaaaauggcgaacauguguuuucau

SEQ ID NO: 136358 - RNA, 21 nt, Human
uucuucugaagugcugcucca

SEQ ID NO: 136359 - RNA, 22 nt, Human
cucccagacccuucuuuagaag

SEQ ID NO: 136360 - RNA, 23 nt, Human
acugggcaccaggagugccuuca

SEQ ID NO: 136361 - RNA, 21 nt, Human
aaagucagggaggacuuccua

SEQ ID NO: 136362 - RNA, 23 nt, Human
gccuccuuccauugcaucauuuu

SEQ ID NO: 136363 - RNA, 21 nt, Human
uauuaaaacaagaauuuuccu

SEQ ID NO: 136364 - RNA, 21 nt, Human
guuaggcccugcacuccaccu

SEQ ID NO: 136365 - RNA, 26 nt, Human
uguuuuggacuacauauuugcacuga

SEQ ID NO: 136366 - RNA, 21 nt, Human
gacuacccucucacuagugcc

SEQ ID NO: 136367 - RNA, 20 nt, Human
ugcccaggcuggagugcagu

SEQ ID NO: 136368 - RNA, 20 nt, Human
ugcccaggcuagagugcaau

SEQ ID NO: 136369 - RNA, 20 nt, Human
cgcccaggcuggaguguagu

SEQ ID NO: 136370 - RNA, 21 nt, Human
gagacacacuuaacuacuuau

SEQ ID NO: 136371 - RNA, 22 nt, Human
gguuugaagcaaccuccagcuu

SEQ ID NO: 136372 - RNA, 23 nt, Human
gcuugucccccugucagcugccu

SEQ ID NO: 136373 - RNA, 20 nt, Human
ccacaggaacaucauuccuc

SEQ ID NO: 136374 - RNA, 27 nt, Human
ccaccucuucccgcacccagcaugcag

SEQ ID NO: 136375 - RNA, 26 nt, Human
uucugcuucucucuucucucaacccc

SEQ ID NO: 136376 - RNA, 24 nt, Human
ccugcugcagccccagggccccuc

SEQ ID NO: 136377 - RNA, 22 nt, Human
aaaugauuugucgccugucuga

SEQ ID NO: 136378 - RNA, 28 nt, Human
uucaguuuuucuuuacuucuuuugaaaa

SEQ ID NO: 136379 - RNA, 24 nt, Human
cuugugacgcggaccucagugcca

SEQ ID NO: 136380 - RNA, 21 nt, Human
gccuuuauugguugcaauggg

SEQ ID NO: 136381 - RNA, 22 nt, Human
cuggguucuagggcagggauac

SEQ ID NO: 136382 - RNA, 25 nt, Human
gcggagugcgcugcgccgcccagcc

SEQ ID NO: 136383 - RNA, 27 nt, Human
gaguagcugggauuacaggcgcccgcc

SEQ ID NO: 136384 - RNA, 24 nt, Human
agggccaaucuucccucagcccac

SEQ ID NO: 136385 - RNA, 22 nt, Human
agugucacuuccggccucucug

SEQ ID NO: 136386 - RNA, 21 nt, Human
gaaucuaaugcuuccaaaaau

SEQ ID NO: 136387 - RNA, 27 nt, Human
ccagguggcaggucgcaguuggguacc

SEQ ID NO: 136388 - RNA, 23 nt, Human
ccuagugccagagcuugcauccu

SEQ ID NO: 136389 - RNA, 24 nt, Human
cacuggagguugaagccaaguggg

SEQ ID NO: 136390 - RNA, 32 nt, Human
ggguauggcaagagaguggcagacauaaagga

SEQ ID NO: 136391 - RNA, 24 nt, Human
cacagguugcagguuagcaggaga

SEQ ID NO: 136392 - RNA, 19 nt, Human
uucuggugaugggguuuag

SEQ ID NO: 136393 - RNA, 22 nt, Human
gggcuguggcccugcccuuggc

SEQ ID NO: 136394 - RNA, 17 nt, Human
ugcggcagagcauuugg

SEQ ID NO: 136395 - RNA, 24 nt, Human
aaggugccugaaaaguuuggggga

SEQ ID NO: 136396 - RNA, 22 nt, Human
cugugaggaagagguugcagug

SEQ ID NO: 136397 - RNA, 22 nt, Human
ucagaacuuugccauuugucua

SEQ ID NO: 136398 - RNA, 24 nt, Human
uucuucccucuccugcgcgcagcc

SEQ ID NO: 136399 - RNA, 16 nt, Human
gacuucacugucugag

SEQ ID NO: 136400 - RNA, 22 nt, Human
ugcuucacucucucauucuuag

SEQ ID NO: 136401 - RNA, 26 nt, Human
cuuugcaaccuguucucagcucugcc

SEQ ID NO: 136402 - RNA, 27 nt, Human
cuaucagaaaugguuuucauuaaggga

SEQ ID NO: 136403 - RNA, 20 nt, Human
cacacacaaccuccccuguu

SEQ ID NO: 136404 - RNA, 22 nt, Human
gccucccagguucacgccauuc

SEQ ID NO: 136405 - RNA, 25 nt, Human
gcauuuagguggagacuucuuccca

SEQ ID NO: 136406 - RNA, 23 nt, Human
aaaauugaagaauuggauuaagg

SEQ ID NO: 136407 - RNA, 21 nt, Human
uucucucuccucucugcuuca

SEQ ID NO: 136408 - RNA, 22 nt, Human
guauuugaauucauacuagaau

SEQ ID NO: 136409 - RNA, 22 nt, Human
ucugccuggagugcugugcugu

SEQ ID NO: 136410 - RNA, 22 nt, Human
cuaacucccauugacauugcuu

SEQ ID NO: 136411 - RNA, 24 nt, Human
aagucacuggauaaaaugagaauu

SEQ ID NO: 136412 - RNA, 22 nt, Human
gucacccaggcugccaggcugg

SEQ ID NO: 136413 - RNA, 27 nt, Human
ggcagcuggaucuguuugcaugcagga

SEQ ID NO: 136414 - RNA, 16 nt, Human
auucuuucccaccuca

SEQ ID NO: 136415 - RNA, 21 nt, Human
uuaucuaguguuugauuguca

SEQ ID NO: 136416 - RNA, 32 nt, Human
acugacacucacccugcccugccccuggccag

SEQ ID NO: 136417 - RNA, 13 nt, Human
accauaaaccuua

SEQ ID NO: 136418 - RNA, 25 nt, Human
uuugcagaaggaaauuucugaugca

SEQ ID NO: 136419 - RNA, 22 nt, Human
accaugccaggcuaauuuuugu

SEQ ID NO: 136420 - RNA, 23 nt, Human
caucaagaaaccucaucuugccu

SEQ ID NO: 136421 - RNA, 23 nt, Human
cccugggucccacuccugcccca

SEQ ID NO: 136422 - RNA, 21 nt, Human
ggcaaggacaguggagagagu

SEQ ID NO: 136423 - RNA, 22 nt, Human
gaacucugggcugccaugugaa

SEQ ID NO: 136424 - RNA, 22 nt, Human
cagagugaaagcagaggcguga

SEQ ID NO: 136425 - RNA, 26 nt, Human
aacucauauguuuaauugaauugaaa

SEQ ID NO: 136426 - RNA, 24 nt, Human
cgcucucguuuugucaggcagcua

SEQ ID NO: 136427 - RNA, 21 nt, Human
cuccggcccggcucccgccuc

SEQ ID NO: 136428 - RNA, 27 nt, Human
ggaggcugaagcaggauaaucgcuuga

SEQ ID NO: 136429 - RNA, 27 nt, Human
agguuucuagagccaucugggcuuucc

SEQ ID NO: 136430 - RNA, 26 nt, Human
gccuuucuccucccaggaucugggaa

SEQ ID NO: 136431 - RNA, 25 nt, Human
aggggagggggcgcccaggaggggu

SEQ ID NO: 136432 - RNA, 27 nt, Human
ucuccagcagagcucuggccagcugcc

SEQ ID NO: 136433 - RNA, 21 nt, Human
uucagauagguugaucuuugg

SEQ ID NO: 136434 - RNA, 27 nt, Human
gcacuguucugauuauguaagcauuug

SEQ ID NO: 136435 - RNA, 21 nt, Human
ccucccaggagaaucacuuga

SEQ ID NO: 136436 - RNA, 24 nt, Human
gucaugccuccugcauuucgcuac

SEQ ID NO: 136437 - RNA, 21 nt, Human
auccagagaccugcuccagau

SEQ ID NO: 136438 - RNA, 30 nt, Human
uaggagagcugggggcaggagaauggggug

SEQ ID NO: 136439 - RNA, 20 nt, Human
uuaacuuggaaaucaguaga

SEQ ID NO: 136440 - RNA, 27 nt, Human
uagccuuuuauuauuuuucucuucuuu

SEQ ID NO: 136441 - RNA, 25 nt, Human
cugaguauaaucaauaagcuagaua

SEQ ID NO: 136442 - RNA, 20 nt, Human
aucucugagucccaaaaaga

SEQ ID NO: 136443 - RNA, 21 nt, Human
ggcaguuacagacagguuaac

SEQ ID NO: 136444 - RNA, 28 nt, Human
uucacgcuuggugugaauacuuuauuau

SEQ ID NO: 136445 - RNA, 26 nt, Human
ccaaagguggagguugcaguaagcug

SEQ ID NO: 136446 - RNA, 22 nt, Human
acuaaacaaagagugaaggauu

SEQ ID NO: 136447 - RNA, 24 nt, Human
aagugugugugaguggugaacccu

SEQ ID NO: 136448 - RNA, 21 nt, Human
caggcagcaggcuguggagga

SEQ ID NO: 136449 - RNA, 21 nt, Human
accuguuauaccagcacuuug

SEQ ID NO: 136450 - RNA, 26 nt, Human
accuccucuacuuuaacugugcucuc

SEQ ID NO: 136451 - RNA, 22 nt, Human
uucuccgucagcaacaggcugg

SEQ ID NO: 136452 - RNA, 22 nt, Human
acacaaaugcacacacaugcac

SEQ ID NO: 136453 - RNA, 25 nt, Human
ccuccaugggcccugcaggagggga

SEQ ID NO: 136454 - RNA, 20 nt, Human
ggccuuaggguuccuucugc

SEQ ID NO: 136455 - RNA, 22 nt, Human
guguguuacacauaugucugua

SEQ ID NO: 136456 - RNA, 25 nt, Human
gcucacuguugccucgcugucugcc

SEQ ID NO: 136457 - RNA, 27 nt, Human
ugccuucuguuucccaggcagcucugu

SEQ ID NO: 136458 - RNA, 22 nt, Human
uuaccuuuuugauauaaaauca

SEQ ID NO: 136459 - RNA, 23 nt, Human
ggagccuccugcucccugcucca

SEQ ID NO: 136460 - RNA, 26 nt, Human
ccagcaggcccaggccagccagggcu

SEQ ID NO: 136461 - RNA, 18 nt, Human
aggggcauggcucugcug

SEQ ID NO: 136462 - RNA, 23 nt, Human
cauggccgccuggagaagccgcu

SEQ ID NO: 136463 - RNA, 21 nt, Human
uaguucugaaaaguuggaagg

SEQ ID NO: 136464 - RNA, 21 nt, Human
ggagaugggucugauuauagc

SEQ ID NO: 136465 - RNA, 23 nt, Human
gaagcagcaguuauggagcuucc

SEQ ID NO: 136466 - RNA, 22 nt, Human
cugaguacaguacucuuuguca

SEQ ID NO: 136467 - RNA, 19 nt, Human
acugcauuuuggugaccuc

SEQ ID NO: 136468 - RNA, 23 nt, Human
ucccaccaggcuucauucaccca

SEQ ID NO: 136469 - RNA, 21 nt, Human
uugccaagacaaaucaacaga

SEQ ID NO: 136470 - RNA, 26 nt, Human
gcuguggcuuuucaguuaaaauuuug

SEQ ID NO: 136471 - RNA, 20 nt, Human
ucccuucuggacacugagag

SEQ ID NO: 136472 - RNA, 21 nt, Human
uucagcuguauuuccacagau

SEQ ID NO: 136473 - RNA, 25 nt, Human
ugccaugacauuggaagaagguggu

SEQ ID NO: 136474 - RNA, 27 nt, Human
uuagcucagagcacagaggagugccuu

SEQ ID NO: 136475 - RNA, 20 nt, Human
uuuccuuugagcaucaugcc

SEQ ID NO: 136476 - RNA, 21 nt, Human
cuuguggaucauuccuuccuc

SEQ ID NO: 136477 - RNA, 24 nt, Human
aggauuaauccucuugcaccagcu

SEQ ID NO: 136478 - RNA, 25 nt, Human
uccuuucucagccuccagcugggcu

SEQ ID NO: 136479 - RNA, 20 nt, Human
uuccaaaacacacguuucuu

SEQ ID NO: 136480 - RNA, 27 nt, Human
gaggccagaccugcccugccccauugu

SEQ ID NO: 136481 - RNA, 20 nt, Human
ucccccuccucuuacuccgc

SEQ ID NO: 136482 - RNA, 21 nt, Human
agguucuccaaggauccccuc

SEQ ID NO: 136483 - RNA, 26 nt, Human
gcccuuccaaacucuucccucucuca

SEQ ID NO: 136484 - RNA, 27 nt, Human
gcccugggccuuucccacagugcaaug

SEQ ID NO: 136485 - RNA, 30 nt, Human
cacugcgcccugggggccugggcucugcug

SEQ ID NO: 136486 - RNA, 23 nt, Human
gugagcccagugugcuugagugu

SEQ ID NO: 136487 - RNA, 21 nt, Human
aggcugacagaggcggccuca

SEQ ID NO: 136488 - RNA, 19 nt, Human
uaggaggggagcagaggaa

SEQ ID NO: 136489 - RNA, 24 nt, Human
gcacacuauauuccaccacuuugg

SEQ ID NO: 136490 - RNA, 27 nt, Human
gacuguacuuucuauuuuaaucuugcu

SEQ ID NO: 136491 - RNA, 27 nt, Human
gugagcaggcuuugggaacacuggccu

SEQ ID NO: 136492 - RNA, 20 nt, Human
cggcugucuugccucuuguc

SEQ ID NO: 136493 - RNA, 27 nt, Human
aggaguuaaagaccagccugggcaaca

SEQ ID NO: 136494 - RNA, 19 nt, Human
gcaccaaaaaacuaaagca

SEQ ID NO: 136495 - RNA, 23 nt, Human
ggcuaauuuuuuauauuuuuagu

SEQ ID NO: 136496 - RNA, 22 nt, Human
guugcccaggcuggaaugcagu

SEQ ID NO: 136497 - RNA, 28 nt, Human
aggcugagaaucagagacauuucagcag

SEQ ID NO: 136498 - RNA, 27 nt, Human
uuuuccccugggucagugauggaaagg

SEQ ID NO: 136499 - RNA, 22 nt, Human
uuuguaguuuucaccaugacag

SEQ ID NO: 136500 - RNA, 22 nt, Human
caaaaagugggggcuguacugg

SEQ ID NO: 136501 - RNA, 18 nt, Human
agggugacccugaaguga

SEQ ID NO: 136502 - RNA, 21 nt, Human
gacugccagccccuguccucc

SEQ ID NO: 136503 - RNA, 21 nt, Human
uccucuaagaggagaugaugu

SEQ ID NO: 136504 - RNA, 21 nt, Human
ccagaguagcugauguaggag

SEQ ID NO: 136505 - RNA, 27 nt, Human
cucuccucagcuggaaugaggaaugua

SEQ ID NO: 136506 - RNA, 26 nt, Human
acagugagugugggggaaauguagua

SEQ ID NO: 136507 - RNA, 27 nt, Human
uaagcaggcagcaggaacuuuaaauuu

SEQ ID NO: 136508 - RNA, 16 nt, Human
ucguggccaagcacaa

SEQ ID NO: 136509 - RNA, 21 nt, Human
ugcacacagcuuuugcuuagu

SEQ ID NO: 136510 - RNA, 26 nt, Human
aagaaacaaagaggacacggcugguu

SEQ ID NO: 136511 - RNA, 22 nt, Human
aucauggguuccucccuucuuc

SEQ ID NO: 136512 - RNA, 24 nt, Human
auacuauauacguuuuguauauca

SEQ ID NO: 136513 - RNA, 25 nt, Human
uuuuauuccaacuccgagcacugug

SEQ ID NO: 136514 - RNA, 26 nt, Human
guccccaaggauugggagcaugggag

SEQ ID NO: 136515 - RNA, 26 nt, Human
gcucugucaccaggcuggagugcagu

SEQ ID NO: 136516 - RNA, 23 nt, Human
ccuuccccacuucugugccaccc

SEQ ID NO: 136517 - RNA, 19 nt, Human
aauggccaucuaaugcuau

SEQ ID NO: 136518 - RNA, 28 nt, Human
uguuaccugccugucaucaugaaagccu

SEQ ID NO: 136519 - RNA, 24 nt, Human
ucccauacacccaaggcuuguuuc

SEQ ID NO: 136520 - RNA, 27 nt, Human
uccuuuggagaggagauuaugauguga

SEQ ID NO: 136521 - RNA, 26 nt, Human
uaggccgggugcaguggcucaugccu

SEQ ID NO: 136522 - RNA, 22 nt, Human
ucacccaggcuggaaugcagug

SEQ ID NO: 136523 - RNA, 18 nt, Human
ucucucucaccaggauuu

SEQ ID NO: 136524 - RNA, 20 nt, Human
agcuaaaacugcagcauuuu

SEQ ID NO: 136525 - RNA, 24 nt, Human
ggcauaggccagggugguuauugc

SEQ ID NO: 136526 - RNA, 21 nt, Human
gagcuggucacuccucaggac

SEQ ID NO: 136527 - RNA, 22 nt, Human
cucuccaggaauccgcggaggg

SEQ ID NO: 136528 - RNA, 20 nt, Human
cucugcgucccacugagucu

SEQ ID NO: 136529 - RNA, 20 nt, Human
aagaaauugaaguauccuua

SEQ ID NO: 136530 - RNA, 23 nt, Human
uacuagcccuuuuuauauauuua

SEQ ID NO: 136531 - RNA, 22 nt, Human
cauugcacuccagccugggcgg

SEQ ID NO: 136532 - RNA, 24 nt, Human
ccaugaauccugaccacucuugaa

SEQ ID NO: 136533 - RNA, 21 nt, Human
guuuuucugaauauuuauuuu

SEQ ID NO: 136534 - RNA, 26 nt, Human
acacucaguguccaguugcagcugga

SEQ ID NO: 136535 - RNA, 28 nt, Human
ugcaaagcaaaacagacuguguuuaacu

SEQ ID NO: 136536 - RNA, 21 nt, Human
ccagagaugacugaaaccacu

SEQ ID NO: 136537 - RNA, 27 nt, Human
gcccagcccugucagcugcgccgggac

SEQ ID NO: 136538 - RNA, 29 nt, Human
gcagauaucugcaugugucaugaagaaug

SEQ ID NO: 136539 - RNA, 26 nt, Human
ugagccaagaugacacaacugcacuc

SEQ ID NO: 136540 - RNA, 23 nt, Human
auguuaaguagaaguagcuuuuu

SEQ ID NO: 136541 - RNA, 23 nt, Human
gaauccagcagaauccucacaga

SEQ ID NO: 136542 - RNA, 22 nt, Human
ucgagcggucgaggucgcagac

SEQ ID NO: 136543 - RNA, 22 nt, Human
ccccaaaggaaccagaggugaa

SEQ ID NO: 136544 - RNA, 21 nt, Human
gacggcccaggcuccuccucc

SEQ ID NO: 136545 - RNA, 22 nt, Human
cgaugguggaaacaguggggaa

SEQ ID NO: 136546 - RNA, 21 nt, Human
uacucuuugugcaagugccuu

SEQ ID NO: 136547 - RNA, 21 nt, Human
gguccaggcugcaggggcugg

SEQ ID NO: 136548 - RNA, 27 nt, Human
uucucauccacugugcuucuuaaugug

SEQ ID NO: 136549 - RNA, 21 nt, Human
guagggagaccauauaauaau

SEQ ID NO: 136550 - RNA, 25 nt, Human
gguucugcaaggagccuauaaagcc

SEQ ID NO: 136551 - RNA, 27 nt, Human
gucucgaacuccugggcucaagccguu

SEQ ID NO: 136552 - RNA, 25 nt, Human
uagaaagggaggcagcuuuugaggu

SEQ ID NO: 136553 - RNA, 31 nt, Human
gcacgaggcccuggccuucgcgcaucuccca

SEQ ID NO: 136554 - RNA, 19 nt, Human
gucccauuuuucucuugcc

SEQ ID NO: 136555 - RNA, 25 nt, Human
cagcauccuggaaauuugugugcuu

SEQ ID NO: 136556 - RNA, 26 nt, Human
gagcauguugggugugagggaacaca

SEQ ID NO: 136557 - RNA, 22 nt, Human
agccuccccaguagcugagauu

SEQ ID NO: 136558 - RNA, 26 nt, Human
cugcuccccagcucucggauacagcc

SEQ ID NO: 136559 - RNA, 27 nt, Human
caggcuggagugcaaugacacagucuu

SEQ ID NO: 136560 - RNA, 22 nt, Human
agacuagaggucaguggcagga

SEQ ID NO: 136561 - RNA, 27 nt, Human
ccuugauacuguugccugccuuuuuag

SEQ ID NO: 136562 - RNA, 21 nt, Human
guuaguaccggguucaguuua

SEQ ID NO: 136563 - RNA, 20 nt, Human
acugguguagcugcaaggau

SEQ ID NO: 136564 - RNA, 17 nt, Human
cugcacuccagacuggg

SEQ ID NO: 136565 - RNA, 18 nt, Human
cuuaaaacuuugaaguua

SEQ ID NO: 136566 - RNA, 24 nt, Human
cugagucuauguucaaagacugug

SEQ ID NO: 136567 - RNA, 22 nt, Human
caggcuggagugcaguggcacu

SEQ ID NO: 136568 - RNA, 22 nt, Human
ggacuguuucguuucugcuucu

SEQ ID NO: 136569 - RNA, 19 nt, Human
ccaagagagggucccaguc

SEQ ID NO: 136570 - RNA, 26 nt, Human
cugggagaaagagagagcuucuguug

SEQ ID NO: 136571 - RNA, 26 nt, Human
uuccccucaucuuccaggcaacagug

SEQ ID NO: 136572 - RNA, 21 nt, Human
cuccugagagaaaggucugac

SEQ ID NO: 136573 - RNA, 23 nt, Human
uguugcccaagcuggagugcaau

SEQ ID NO: 136574 - RNA, 23 nt, Human
uauugcccaggcuggagugcaau

SEQ ID NO: 136575 - RNA, 22 nt, Human
cacuacacuccggaugguguau

SEQ ID NO: 136576 - RNA, 22 nt, Human
agugcggaguguggagcuggac

SEQ ID NO: 136577 - RNA, 21 nt, Human
ccaaacacuaaggaugcugaa

SEQ ID NO: 136578 - RNA, 21 nt, Human
guuucacugcaaacacaccuu

SEQ ID NO: 136579 - RNA, 24 nt, Human
cacugcacaccagucuggagacag

SEQ ID NO: 136580 - RNA, 25 nt, Human
uucaaaauuguaugcuuuuuuccau

SEQ ID NO: 136581 - RNA, 21 nt, Human
uucuucuccucccuauuucgc

SEQ ID NO: 136582 - RNA, 25 nt, Human
acggaguuuauagcucacugcaaau

SEQ ID NO: 136583 - RNA, 21 nt, Human
uccuucuaucuugugaugcca

SEQ ID NO: 136584 - RNA, 21 nt, Human
cugcugcugcuauugucuuuc

SEQ ID NO: 136585 - RNA, 24 nt, Human
ccugccagccuggcuucuggagcc

SEQ ID NO: 136586 - RNA, 26 nt, Human
ggaguauuugggagagacuggcugca

SEQ ID NO: 136587 - RNA, 23 nt, Human
cacacacaccccuguccuccagc

SEQ ID NO: 136588 - RNA, 30 nt, Human
gcagccacacccugcccugccccgccccgc

SEQ ID NO: 136589 - RNA, 18 nt, Human
uuuauuuccaccuccucc

SEQ ID NO: 136590 - RNA, 20 nt, Human
ucgccaggcuggaguguagu

SEQ ID NO: 136591 - RNA, 26 nt, Human
cugcuuccuccgccugcugccuggac

SEQ ID NO: 136592 - RNA, 25 nt, Human
ugcuuuaauuucuucccuuucagca

SEQ ID NO: 136593 - RNA, 19 nt, Human
gggcagccagcagaggggg

SEQ ID NO: 136594 - RNA, 20 nt, Human
ggagaugagaccuaccuucc

SEQ ID NO: 136595 - RNA, 22 nt, Human
agucucaaacuccuggccucau

SEQ ID NO: 136596 - RNA, 21 nt, Human
cagggcuggggcagugucugu

SEQ ID NO: 136597 - RNA, 29 nt, Human
gagucugcagauagaaagcauuacauugu

SEQ ID NO: 136598 - RNA, 23 nt, Human
uuccuccaaggcuggagugcagu

SEQ ID NO: 136599 - RNA, 25 nt, Human
gcaucuugaggccacacccagccuu

SEQ ID NO: 136600 - RNA, 23 nt, Human
caguuucucaaacugagcuucag

SEQ ID NO: 136601 - RNA, 23 nt, Human
uuccuaugucaaauuagccagaa

SEQ ID NO: 136602 - RNA, 21 nt, Human
guauuaggcuaaugcuguguu

SEQ ID NO: 136603 - RNA, 25 nt, Human
ucuccacccucugggccucaguguc

SEQ ID NO: 136604 - RNA, 24 nt, Human
ucugcugcuucuccaagcuuucag

SEQ ID NO: 136605 - RNA, 25 nt, Human
gggggauuacugagagucaggcuag

SEQ ID NO: 136606 - RNA, 28 nt, Human
cugaguauguggaaggcagcagagcgga

SEQ ID NO: 136607 - RNA, 20 nt, Human
ccuggcuucuuucucuuggg

SEQ ID NO: 136608 - RNA, 27 nt, Human
guagauugccagcacagugaguuuccc

SEQ ID NO: 136609 - RNA, 22 nt, Human
agacacauacacccaaacacuu

SEQ ID NO: 136610 - RNA, 29 nt, Human
agugcccagcagagguuugcugacaggug

SEQ ID NO: 136611 - RNA, 22 nt, Human
cauggaacccugaaguggcagu

SEQ ID NO: 136612 - RNA, 20 nt, Human
ugugugccuggcuguguacg

SEQ ID NO: 136613 - RNA, 23 nt, Human
gucuuguucagauucuguauuua

SEQ ID NO: 136614 - RNA, 27 nt, Human
uggccaacauggggaaaccccgucucu

SEQ ID NO: 136615 - RNA, 27 nt, Human
ggaggcugagucaggagaaucgcuuga

SEQ ID NO: 136616 - RNA, 21 nt, Human
ucucuagccuuccuuuucugc

SEQ ID NO: 136617 - RNA, 27 nt, Human
gcacagccacccguggggugcugcccu

SEQ ID NO: 136618 - RNA, 25 nt, Human
gcuguuuuaacuaucccugccugug

SEQ ID NO: 136619 - RNA, 27 nt, Human
cuguucccagccccuccucccucaggc

SEQ ID NO: 136620 - RNA, 18 nt, Human
gggcuguacauaguguuc

SEQ ID NO: 136621 - RNA, 21 nt, Human
uccugcuccugggaugcacug

SEQ ID NO: 136622 - RNA, 23 nt, Human
ugccucccucaaaggaccugcag

SEQ ID NO: 136623 - RNA, 20 nt, Human
cucaggcuggagugcaguga

SEQ ID NO: 136624 - RNA, 18 nt, Human
gagggagggauuagaagc

SEQ ID NO: 136625 - RNA, 23 nt, Human
ccgggagccgucgcaggucucgg

SEQ ID NO: 136626 - RNA, 22 nt, Human
ccucaucguccaccugccucgg

SEQ ID NO: 136627 - RNA, 17 nt, Human
uucucccugcagcugcc

SEQ ID NO: 136628 - RNA, 22 nt, Human
ugggcuguggcugucagcccau

SEQ ID NO: 136629 - RNA, 23 nt, Human
aggugucauacagauuugcaaag

SEQ ID NO: 136630 - RNA, 22 nt, Human
cccgagccgagcucuccugggc

SEQ ID NO: 136631 - RNA, 25 nt, Human
acaggagcuaauggaagugacaguc

SEQ ID NO: 136632 - RNA, 22 nt, Human
cucucauuccuuccgugccaug

SEQ ID NO: 136633 - RNA, 24 nt, Human
ucgggaggcuaaggcaggagaauc

SEQ ID NO: 136634 - RNA, 24 nt, Human
cacuguccagccuggagggaggca

SEQ ID NO: 136635 - RNA, 26 nt, Human
agagcacagcagacccuuagcagaac

SEQ ID NO: 136636 - RNA, 24 nt, Human
ucccaugagccucagcauccuggc

SEQ ID NO: 136637 - RNA, 23 nt, Human
ucugcugcucgcucaccugccug

SEQ ID NO: 136638 - RNA, 22 nt, Human
gugaagagccuaugugcauuuu

SEQ ID NO: 136639 - RNA, 22 nt, Human
agcccuaccugccagugcuggu

SEQ ID NO: 136640 - RNA, 26 nt, Human
accggcccggcgugggcacacagaca

SEQ ID NO: 136641 - RNA, 19 nt, Human
gaagagagauguguggaaa

SEQ ID NO: 136642 - RNA, 25 nt, Human
agugugcuacagcuuccagcccguu

SEQ ID NO: 136643 - RNA, 22 nt, Human
agggagacuagguuauucucug

SEQ ID NO: 136644 - RNA, 26 nt, Human
ggagagaagauuggcgcugggugccg

SEQ ID NO: 136645 - RNA, 23 nt, Human
ccuccacuguuugaccaaauucu

SEQ ID NO: 136646 - RNA, 20 nt, Human
ggggugaguggacguguugg

SEQ ID NO: 136647 - RNA, 19 nt, Human
acagguucaaauauucaag

SEQ ID NO: 136648 - RNA, 21 nt, Human
uuccaaggcaucaccuuccuu

SEQ ID NO: 136649 - RNA, 19 nt, Human
cacugauuuuguagagcug

SEQ ID NO: 136650 - RNA, 26 nt, Human
accaugguuuguauacuagaagucuu

SEQ ID NO: 136651 - RNA, 23 nt, Human
ccucagccugcaaccucuauccu

SEQ ID NO: 136652 - RNA, 25 nt, Human
uuccggcuccagccuccaauccgac

SEQ ID NO: 136653 - RNA, 24 nt, Human
uggaugucacuuuggaaaccaagc

SEQ ID NO: 136654 - RNA, 21 nt, Human
ugcccagguccugggguggug

SEQ ID NO: 136655 - RNA, 20 nt, Human
ucuaauauuuuuuaaaacaa

SEQ ID NO: 136656 - RNA, 19 nt, Human
cccaaauucuaaauagcug

SEQ ID NO: 136657 - RNA, 22 nt, Human
auaaaccugccaagagucaaca

SEQ ID NO: 136658 - RNA, 20 nt, Human
ucaaacugaguaaauuggaa

SEQ ID NO: 136659 - RNA, 22 nt, Human
uuuucauuuuggagcuaguuac

SEQ ID NO: 136660 - RNA, 21 nt, Human
uuacccuggaaucaguuuuga

SEQ ID NO: 136661 - RNA, 27 nt, Human
ggauuacugccuuuuguagguacuuca

SEQ ID NO: 136662 - RNA, 21 nt, Human
ucuguaauacagcauuuuuau

SEQ ID NO: 136663 - RNA, 23 nt, Human
aggccuuucugugaacagcauca

SEQ ID NO: 136664 - RNA, 27 nt, Human
aaagugcugggauuacaggcgcgagcc

SEQ ID NO: 136665 - RNA, 24 nt, Human
ccucuuccucauuccauugcccca

SEQ ID NO: 136666 - RNA, 26 nt, Human
ucuucugcuccggcuguuucacugcg

SEQ ID NO: 136667 - RNA, 20 nt, Human
uuagagucuucaucuguccg

SEQ ID NO: 136668 - RNA, 22 nt, Human
cauggaagcaauaaagcucuuc

SEQ ID NO: 136669 - RNA, 19 nt, Human
gugagcucuucaaaaugaa

SEQ ID NO: 136670 - RNA, 28 nt, Human
ucacaguaccucacaggucucuuccccc

SEQ ID NO: 136671 - RNA, 23 nt, Human
caugugcugcggucacucaggcc

SEQ ID NO: 136672 - RNA, 20 nt, Human
ugccucgacuccugcaccug

SEQ ID NO: 136673 - RNA, 25 nt, Human
cuguuuuccuccccucuguguacuc

SEQ ID NO: 136674 - RNA, 25 nt, Human
uguaaacccugacggugggccuggc

SEQ ID NO: 136675 - RNA, 24 nt, Human
ccugcagggcccugccucccaagc

SEQ ID NO: 136676 - RNA, 21 nt, Human
aucuaucuuauuguucuugaa

SEQ ID NO: 136677 - RNA, 23 nt, Human
ucuauucugggggcuucugagag

SEQ ID NO: 136678 - RNA, 22 nt, Human
gucucuuucccugucugggccu

SEQ ID NO: 136679 - RNA, 20 nt, Human
cccccacccucuccccugcc

SEQ ID NO: 136680 - RNA, 21 nt, Human
uucucaucuacucgucucaca

SEQ ID NO: 136681 - RNA, 24 nt, Human
gauaagcuucaauaguggcauacc

SEQ ID NO: 136682 - RNA, 22 nt, Human
uuuccaaaugaacuugcacuug

SEQ ID NO: 136683 - RNA, 22 nt, Human
gcaacuugggggaaaguuuaga

SEQ ID NO: 136684 - RNA, 28 nt, Human
cucagggagaucacagcaaccuaaauaa

SEQ ID NO: 136685 - RNA, 24 nt, Human
aaggagguggggcgcguuucagug

SEQ ID NO: 136686 - RNA, 24 nt, Human
ugagagcucagaggauuccugcca

SEQ ID NO: 136687 - RNA, 22 nt, Human
guccggucccugucccagugcc

SEQ ID NO: 136688 - RNA, 20 nt, Human
ugcuuaauuauagcacuuua

SEQ ID NO: 136689 - RNA, 20 nt, Human
agaaggggaggacacuggug

SEQ ID NO: 136690 - RNA, 22 nt, Human
gggaaaaauaaacacacaaaaa

SEQ ID NO: 136691 - RNA, 22 nt, Human
uguugcccaggcuagcaugcaa

SEQ ID NO: 136692 - RNA, 22 nt, Human
gacccgcccuccagcugcccuc

SEQ ID NO: 136693 - RNA, 24 nt, Human
agcucaguuucuuuuucacuuggg

SEQ ID NO: 136694 - RNA, 27 nt, Human
caggcagcugggcauggaggugcuggg

SEQ ID NO: 136695 - RNA, 28 nt, Human
cagaugacacuuaagaccuacuugugau

SEQ ID NO: 136696 - RNA, 18 nt, Human
ccucuuguguucuugccu

SEQ ID NO: 136697 - RNA, 23 nt, Human
cuaaccuguaaucccagcuacuu

SEQ ID NO: 136698 - RNA, 24 nt, Human
ccaaacuaccugucaccauggccc

SEQ ID NO: 136699 - RNA, 19 nt, Human
gcugcagccaucccccuca

SEQ ID NO: 136700 - RNA, 22 nt, Human
aaagacuguacauauuuacaag

SEQ ID NO: 136701 - RNA, 22 nt, Human
guaaaaauuaaaaaggccaggc

SEQ ID NO: 136702 - RNA, 20 nt, Human
uaggacuaguguauauucac

SEQ ID NO: 136703 - RNA, 24 nt, Human
uauuucuuagacaagccuuucaca

SEQ ID NO: 136704 - RNA, 23 nt, Human
gugaggagggaagagugugcaga

SEQ ID NO: 136705 - RNA, 26 nt, Human
uggagaccaugucugugccaucucug

SEQ ID NO: 136706 - RNA, 23 nt, Human
ucucaagaggaacagucauugug

SEQ ID NO: 136707 - RNA, 22 nt, Human
augccuggccaacucacauuuu

SEQ ID NO: 136708 - RNA, 27 nt, Human
gucuuccuggguucugaaguaacggaa

SEQ ID NO: 136709 - RNA, 22 nt, Human
agcacagcaauauacauucaua

SEQ ID NO: 136710 - RNA, 21 nt, Human
cgucuuuaagcauuacucuua

SEQ ID NO: 136711 - RNA, 22 nt, Human
aaaacucaaaggugcuagcucc

SEQ ID NO: 136712 - RNA, 24 nt, Human
ggugcagagugcccagaacuggac

SEQ ID NO: 136713 - RNA, 22 nt, Human
acuuucuaggcugagucuagug

SEQ ID NO: 136714 - RNA, 26 nt, Human
gaauuuguucuuacauuauggcuccc

SEQ ID NO: 136715 - RNA, 27 nt, Human
gcccuugcccuguuggaugaauaggca

SEQ ID NO: 136716 - RNA, 22 nt, Human
gagcuagacucugugucaaaaa

SEQ ID NO: 136717 - RNA, 27 nt, Human
gggccuggcagcucagcuuccccaaca

SEQ ID NO: 136718 - RNA, 26 nt, Human
cucagggccucuucuggaaaaugaag

SEQ ID NO: 136719 - RNA, 22 nt, Human
auuggcuucucuucucuccuua

SEQ ID NO: 136720 - RNA, 25 nt, Human
gcuccuccccacuagcaucuucucu

SEQ ID NO: 136721 - RNA, 28 nt, Human
ugguaggaggcagggagaguaagacaug

SEQ ID NO: 136722 - RNA, 20 nt, Human
gggagguugugguugcagug

SEQ ID NO: 136723 - RNA, 22 nt, Human
guucacugcagcuccugucaca

SEQ ID NO: 136724 - RNA, 28 nt, Human
gguacuccugcccuugcuugacucaguu

SEQ ID NO: 136725 - RNA, 21 nt, Human
cuuccuugccaaguuuuccua

SEQ ID NO: 136726 - RNA, 22 nt, Human
aaccucccuggcucaagcgauc

SEQ ID NO: 136727 - RNA, 19 nt, Human
cccaccccacaugacaucc

SEQ ID NO: 136728 - RNA, 20 nt, Human
gcaaaaacuccccuuuuuug

SEQ ID NO: 136729 - RNA, 24 nt, Human
gccaguguccccagcacuuuuagg

SEQ ID NO: 136730 - RNA, 22 nt, Human
cagcggccggcucucaccucuc

SEQ ID NO: 136731 - RNA, 22 nt, Human
uccuccaggcccguggggcugg

SEQ ID NO: 136732 - RNA, 25 nt, Human
gcuucuccucaagcuguaggcucca

SEQ ID NO: 136733 - RNA, 25 nt, Human
ucccaggcuggagugcaguggcaca

SEQ ID NO: 136734 - RNA, 22 nt, Human
cuacaaaaucaacaugauuuca

SEQ ID NO: 136735 - RNA, 21 nt, Human
uaacauaguaaucuuuagcuu

SEQ ID NO: 136736 - RNA, 22 nt, Human
gggccugcccuggauccuggag

SEQ ID NO: 136737 - RNA, 21 nt, Human
uaugaaaagaaagaaaggagg

SEQ ID NO: 136738 - RNA, 22 nt, Human
ugauuauaccacugcacuccag

SEQ ID NO: 136739 - RNA, 22 nt, Human
gucuuccuucuuuaucuauagc

SEQ ID NO: 136740 - RNA, 20 nt, Human
gaacuauauauaagcuagca

SEQ ID NO: 136741 - RNA, 23 nt, Human
ucugggccccgucuucuuugcca

SEQ ID NO: 136742 - RNA, 21 nt, Human
cagcaaguuuucuaucauguc

SEQ ID NO: 136743 - RNA, 22 nt, Human
gucaucugcuggugaccagacc

SEQ ID NO: 136744 - RNA, 19 nt, Human
uguuccuuacagcacuugc

SEQ ID NO: 136745 - RNA, 22 nt, Human
caggaggcggagcuugcaguga

SEQ ID NO: 136746 - RNA, 19 nt, Human
agcauuuucauucauuuua

SEQ ID NO: 136747 - RNA, 22 nt, Human
cccugcccccagagcguccuug

SEQ ID NO: 136748 - RNA, 21 nt, Human
ggaucuguaaaauauaccuuu

SEQ ID NO: 136749 - RNA, 20 nt, Human
cuuuuaaaaaccuaggucuc

SEQ ID NO: 136750 - RNA, 21 nt, Human
cauugagacuugacugggcaa

SEQ ID NO: 136751 - RNA, 23 nt, Human
agcucccagaaccucuucuuccu

SEQ ID NO: 136752 - RNA, 23 nt, Human
cuggucccaguguuaggguagca

SEQ ID NO: 136753 - RNA, 23 nt, Human
ggagaggggaggggacgggcagg

SEQ ID NO: 136754 - RNA, 21 nt, Human
uguuagccaggcuggucucga

SEQ ID NO: 136755 - RNA, 28 nt, Human
cuucacaaacaccucucucuccccugca

SEQ ID NO: 136756 - RNA, 20 nt, Human
gggccaggcaggaagacgcu

SEQ ID NO: 136757 - RNA, 27 nt, Human
guugagcgcucggagggccaaccgccg

SEQ ID NO: 136758 - RNA, 29 nt, Human
guuggacucucuccccuggugucuguacu

SEQ ID NO: 136759 - RNA, 21 nt, Human
uuuuaaaauaguguaggauaa

SEQ ID NO: 136760 - RNA, 23 nt, Human
ccagaaauggugccaaggcugug

SEQ ID NO: 136761 - RNA, 30 nt, Human
cucccauggccuucccuccccacaguccuc

SEQ ID NO: 136762 - RNA, 23 nt, Human
cccuucagugcaggccagccugg

SEQ ID NO: 136763 - RNA, 23 nt, Human
uggcucccagggcuaggguuagg

SEQ ID NO: 136764 - RNA, 21 nt, Human
aaacucaaacuccaaaccuca

SEQ ID NO: 136765 - RNA, 16 nt, Human
caggaauagaagauga

SEQ ID NO: 136766 - RNA, 31 nt, Human
ucagauuucuucuaguauuugcuucugauga

SEQ ID NO: 136767 - RNA, 25 nt, Human
guggaugugucauauauugccaaac

SEQ ID NO: 136768 - RNA, 22 nt, Human
aacucgaaagcacagcuccucc

SEQ ID NO: 136769 - RNA, 22 nt, Human
cugaggcaggaaaaucacuuga

SEQ ID NO: 136770 - RNA, 19 nt, Human
ugcccuggagauauggucc

SEQ ID NO: 136771 - RNA, 21 nt, Human
aaucuaguaugguuacuccag

SEQ ID NO: 136772 - RNA, 19 nt, Human
uucugccaggcaagcccug

SEQ ID NO: 136773 - RNA, 22 nt, Human
gcugggcuuuugcuguccucuu

SEQ ID NO: 136774 - RNA, 27 nt, Human
uacccuuucaccuaccucagcaaaaca

SEQ ID NO: 136775 - RNA, 27 nt, Human
ccgugguagcagccucagccguuucug

SEQ ID NO: 136776 - RNA, 21 nt, Human
ccuccuccuggaccucuuggc

SEQ ID NO: 136777 - RNA, 23 nt, Human
cacuagugccaaugaugugaccc

SEQ ID NO: 136778 - RNA, 22 nt, Human
ccaaaguccugggauuacaggu

SEQ ID NO: 136779 - RNA, 19 nt, Human
gguggcggaggcugaggag

SEQ ID NO: 136780 - RNA, 21 nt, Human
agcgaauuaaccuaagacaca

SEQ ID NO: 136781 - RNA, 21 nt, Human
aggaggucgaggcugcaguga

SEQ ID NO: 136782 - RNA, 21 nt, Human
gggaggucaaggcugcaguga

SEQ ID NO: 136783 - RNA, 25 nt, Human
cuuuguguuuaaaaaucaacuggua

SEQ ID NO: 136784 - RNA, 23 nt, Human
ggucgucacgccuguaaucccag

SEQ ID NO: 136785 - RNA, 21 nt, Human
aagcucagggcuugcagccag

SEQ ID NO: 136786 - RNA, 23 nt, Human
ugcuacagcacauaacacauuuu

SEQ ID NO: 136787 - RNA, 19 nt, Human
gaucagauuguuguauuua

SEQ ID NO: 136788 - RNA, 24 nt, Human
ugcugccucugcugcgcugcgugc

SEQ ID NO: 136789 - RNA, 22 nt, Human
ugagguggggacacaggagguc

SEQ ID NO: 136790 - RNA, 17 nt, Human
gcugggacaagacacug

SEQ ID NO: 136791 - RNA, 19 nt, Human
ccgaagaaagagaggacca

SEQ ID NO: 136792 - RNA, 27 nt, Human
ggaaguuuaaugccaaauguaaaacac

SEQ ID NO: 136793 - RNA, 20 nt, Human
uggucagccgagaaacccca

SEQ ID NO: 136794 - RNA, 22 nt, Human
accagccugggcaagaugguga

SEQ ID NO: 136795 - RNA, 27 nt, Human
aaagugcugggauuacaggcuugagcu

SEQ ID NO: 136796 - RNA, 24 nt, Human
ccucgugauuugccugccugggcc

SEQ ID NO: 136797 - RNA, 20 nt, Human
acacuuaugcauugccaaag

SEQ ID NO: 136798 - RNA, 21 nt, Human
caguugggggaaaauagcauu

SEQ ID NO: 136799 - RNA, 28 nt, Human
gccagccucagcugcuccuuaccuggaa

SEQ ID NO: 136800 - RNA, 24 nt, Human
cgaggcaccacaacaaggccaggu

SEQ ID NO: 136801 - RNA, 23 nt, Human
cuguuccagcccaucugucucac

SEQ ID NO: 136802 - RNA, 26 nt, Human
augugcaaagauuggcucuccaacaa

SEQ ID NO: 136803 - RNA, 21 nt, Human
caaagcaaaaccagaacagua

SEQ ID NO: 136804 - RNA, 26 nt, Human
acagguacagcuucacucuuguaguc

SEQ ID NO: 136805 - RNA, 22 nt, Human
cuccacgggggccuaguggcuu

SEQ ID NO: 136806 - RNA, 19 nt, Human
accucugccccacgcccag

SEQ ID NO: 136807 - RNA, 21 nt, Human
agcacagccagacuugcucag

SEQ ID NO: 136808 - RNA, 25 nt, Human
cagccugcucccagugcugugucau

SEQ ID NO: 136809 - RNA, 26 nt, Human
ccaucccaagauuauguccucacuua

SEQ ID NO: 136810 - RNA, 23 nt, Human
cagagaucuugcauuucugcucu

SEQ ID NO: 136811 - RNA, 19 nt, Human
acugaucuccccugcgacc

SEQ ID NO: 136812 - RNA, 25 nt, Human
gagaaguuccuggcuuaaccuguuc

SEQ ID NO: 136813 - RNA, 23 nt, Human
ccgcugcuaaucuccccugggcc

SEQ ID NO: 136814 - RNA, 22 nt, Human
ucuuccuccuugugcuggguuc

SEQ ID NO: 136815 - RNA, 21 nt, Human
ucgggggcaccuggagggaug

SEQ ID NO: 136816 - RNA, 26 nt, Human
caacagcagcacagaggucuggaggc

SEQ ID NO: 136817 - RNA, 25 nt, Human
uccccagacuugcacugggguggga

SEQ ID NO: 136818 - RNA, 20 nt, Human
ucucuggaggacaagcaguu

SEQ ID NO: 136819 - RNA, 26 nt, Human
ugaaaccagauuucucacuugcucuu

SEQ ID NO: 136820 - RNA, 20 nt, Human
guuaugguaagcaugcacag

SEQ ID NO: 136821 - RNA, 22 nt, Human
ucuuccaaagcccccaggcugg

SEQ ID NO: 136822 - RNA, 21 nt, Human
acagccuccaacuccugggcu

SEQ ID NO: 136823 - RNA, 26 nt, Human
gaccuccaggcuucaauccugccucu

SEQ ID NO: 136824 - RNA, 20 nt, Human
cccuuccauccuccucucca

SEQ ID NO: 136825 - RNA, 22 nt, Human
gaacagcuuuggggcuggggga

SEQ ID NO: 136826 - RNA, 20 nt, Human
cuccuccacucuccaucccc

SEQ ID NO: 136827 - RNA, 20 nt, Human
accaguaggaaccaggcugg

SEQ ID NO: 136828 - RNA, 31 nt, Human
gggccugguugaggcuggagagaacacagug

SEQ ID NO: 136829 - RNA, 21 nt, Human
ccucuucucugccuccagaga

SEQ ID NO: 136830 - RNA, 20 nt, Human
gacucacaagcugguccuug

SEQ ID NO: 136831 - RNA, 21 nt, Human
gcagccuggccaaccugguga

SEQ ID NO: 136832 - RNA, 24 nt, Human
gcucuuuccuuccucacugguacu

SEQ ID NO: 136833 - RNA, 21 nt, Human
ugaaccacgauggcuguugag

SEQ ID NO: 136834 - RNA, 22 nt, Human
acacgagcaauacugugcugga

SEQ ID NO: 136835 - RNA, 22 nt, Human
ugaucaacaugggagacuccca

SEQ ID NO: 136836 - RNA, 23 nt, Human
ggucugagccacagcagcauuuu

SEQ ID NO: 136837 - RNA, 24 nt, Human
gugugaauucucuggcuucuagcu

SEQ ID NO: 136838 - RNA, 18 nt, Human
gacgugcguucugccuuc

SEQ ID NO: 136839 - RNA, 21 nt, Human
ggccauucuuuagucauucca

SEQ ID NO: 136840 - RNA, 25 nt, Human
gaagaauuaaaagggccugugacag

SEQ ID NO: 136841 - RNA, 22 nt, Human
ucucggucuucagcucacacca

SEQ ID NO: 136842 - RNA, 25 nt, Human
gcugcccuaugggccugccgggcug

SEQ ID NO: 136843 - RNA, 22 nt, Human
cacucagcacacuuuuccucca

SEQ ID NO: 136844 - RNA, 22 nt, Human
uacuuauguugcacaaugagaa

SEQ ID NO: 136845 - RNA, 25 nt, Human
aaaauacaaaaauuagccaugcaug

SEQ ID NO: 136846 - RNA, 21 nt, Human
cugucaccugcaacagaagug

SEQ ID NO: 136847 - RNA, 21 nt, Human
acaugccacuacacccagcua

SEQ ID NO: 136848 - RNA, 21 nt, Human
agcaguuggauguucuugccu

SEQ ID NO: 136849 - RNA, 22 nt, Human
cgcucaggcuggagugcaguga

SEQ ID NO: 136850 - RNA, 29 nt, Human
uccaaugcaacaggaagcuagugaaauga

SEQ ID NO: 136851 - RNA, 22 nt, Human
caggugagagaaccaagucuca

SEQ ID NO: 136852 - RNA, 27 nt, Human
cugccuucucugggcucacgacuguuc

SEQ ID NO: 136853 - RNA, 25 nt, Human
cugucccaggagcaggcagggcagu

SEQ ID NO: 136854 - RNA, 22 nt, Human
cuaaguguguacuaguuuaugg

SEQ ID NO: 136855 - RNA, 25 nt, Human
cuguuugccugguuucugacccagu

SEQ ID NO: 136856 - RNA, 22 nt, Human
agugaugugguacaacuggagg

SEQ ID NO: 136857 - RNA, 22 nt, Human
caaacuccugaccucaaguaau

SEQ ID NO: 136858 - RNA, 27 nt, Human
gcaggugacagugagguccugggggcc

SEQ ID NO: 136859 - RNA, 22 nt, Human
uaaagaagaagaucagaggguu

SEQ ID NO: 136860 - RNA, 20 nt, Human
aaacuacagaccucccccgg

SEQ ID NO: 136861 - RNA, 28 nt, Human
ccuuuugcuuugccuuguggacaaugug

SEQ ID NO: 136862 - RNA, 23 nt, Human
guauccagcaagagugaccgggg

SEQ ID NO: 136863 - RNA, 21 nt, Human
caucagcgccggccuccagaa

SEQ ID NO: 136864 - RNA, 20 nt, Human
ggaggggguagaggaaaggc

SEQ ID NO: 136865 - RNA, 24 nt, Human
cuccugagccugcucucugaucag

SEQ ID NO: 136866 - RNA, 23 nt, Human
ggagcacagggugcaggagcggc

SEQ ID NO: 136867 - RNA, 25 nt, Human
ggggagccagagggagcggagcgga

SEQ ID NO: 136868 - RNA, 23 nt, Human
gaccuugugauccacccaccuca

SEQ ID NO: 136869 - RNA, 27 nt, Human
cuguaguauuuaaggagaaaagagaua

SEQ ID NO: 136870 - RNA, 26 nt, Human
caaugccacagcccugucagcaugaa

SEQ ID NO: 136871 - RNA, 27 nt, Human
agauaaaaugugacuuccccugcucug

SEQ ID NO: 136872 - RNA, 22 nt, Human
cuucugcucacggggacccgcu

SEQ ID NO: 136873 - RNA, 24 nt, Human
aguuuaucaguaaauaacuggaaa

SEQ ID NO: 136874 - RNA, 23 nt, Human
cuuugcagauauuggauacccca

SEQ ID NO: 136875 - RNA, 21 nt, Human
gucuuuugauuuuagcuuuau

SEQ ID NO: 136876 - RNA, 27 nt, Human
gguauuuucacccucuucgccugguac

SEQ ID NO: 136877 - RNA, 26 nt, Human
gucuuccuguaguggcaaaaaagaac

SEQ ID NO: 136878 - RNA, 25 nt, Human
gcuccugccccuuccugcuuuugca

SEQ ID NO: 136879 - RNA, 24 nt, Human
gccuccagaaaugaccuccaccuu

SEQ ID NO: 136880 - RNA, 23 nt, Human
acauacagcuagugacgaaugga

SEQ ID NO: 136881 - RNA, 24 nt, Human
uugcccaggaucaagggugcggug

SEQ ID NO: 136882 - RNA, 25 nt, Human
agagucauuuuccccagacacuaca

SEQ ID NO: 136883 - RNA, 23 nt, Human
uucaaauuacuuaccuuccacuc

SEQ ID NO: 136884 - RNA, 22 nt, Human
gaccgaggcacagaggugcggu

SEQ ID NO: 136885 - RNA, 21 nt, Human
uguaugcagggagcacuguuc

SEQ ID NO: 136886 - RNA, 22 nt, Human
acuccugccucagccuccuggg

SEQ ID NO: 136887 - RNA, 24 nt, Human
aauuguauuugaauuugugccucu

SEQ ID NO: 136888 - RNA, 21 nt, Human
agcuaaaauauauaauauacu

SEQ ID NO: 136889 - RNA, 26 nt, Human
ccagcacuuugagaggcugagguggu

SEQ ID NO: 136890 - RNA, 22 nt, Human
ggcucuuggguucaaaguaaua

SEQ ID NO: 136891 - RNA, 22 nt, Human
gaccagccugggcaacacggug

SEQ ID NO: 136892 - RNA, 26 nt, Human
aagccuuucgugagggcuugcaggcc

SEQ ID NO: 136893 - RNA, 22 nt, Human
ggagaaggaggccaggagccag

SEQ ID NO: 136894 - RNA, 22 nt, Human
acuacuccucugcagugccuug

SEQ ID NO: 136895 - RNA, 22 nt, Human
cugccucccagguucaagcaau

SEQ ID NO: 136896 - RNA, 20 nt, Human
ggcugcccugaaguggggac

SEQ ID NO: 136897 - RNA, 26 nt, Human
guauuuuuauacugauuuugauauca

SEQ ID NO: 136898 - RNA, 20 nt, Human
cuccagccugaguccuaggc

SEQ ID NO: 136899 - RNA, 27 nt, Human
aggucuguggugcagugugugaaaauu

SEQ ID NO: 136900 - RNA, 17 nt, Human
uuugcucucccuugacc

SEQ ID NO: 136901 - RNA, 25 nt, Human
gacuacaggugugcaugaggacuac

SEQ ID NO: 136902 - RNA, 24 nt, Human
uuuucagcuucuccaucgccugcc

SEQ ID NO: 136903 - RNA, 27 nt, Human
ugcuuugugaacucugcuuuaaaguga

SEQ ID NO: 136904 - RNA, 22 nt, Human
gcgugagccacugcgcccgggc

SEQ ID NO: 136905 - RNA, 23 nt, Human
uugcccuuuuuaaggaaggcacu

SEQ ID NO: 136906 - RNA, 32 nt, Human
cagccugggcuccucugcaucuugcucugugc

SEQ ID NO: 136907 - RNA, 20 nt, Human
uccuggggaggcugagacug

SEQ ID NO: 136908 - RNA, 23 nt, Human
gucccugauauuuugacuaucuu

SEQ ID NO: 136909 - RNA, 25 nt, Human
aaauguccuuugugggggagaacuc

SEQ ID NO: 136910 - RNA, 23 nt, Human
ccgggacgcagggguugcaguga

SEQ ID NO: 136911 - RNA, 23 nt, Human
uucucucugugcucuugcauucu

SEQ ID NO: 136912 - RNA, 23 nt, Human
ugaguagcugggauuacaggugc

SEQ ID NO: 136913 - RNA, 27 nt, Human
gguucacugcaaccuccgcauccgggg

SEQ ID NO: 136914 - RNA, 19 nt, Human
gguuguuucugaugcagcu

SEQ ID NO: 136915 - RNA, 21 nt, Human
gaguggcccacccuggagaag

SEQ ID NO: 136916 - RNA, 27 nt, Human
ucugcuccagccucucacucucacucu

SEQ ID NO: 136917 - RNA, 19 nt, Human
aggguucccucaagaggaa

SEQ ID NO: 136918 - RNA, 25 nt, Human
ccugaaaaaugcucaaucucagcua

SEQ ID NO: 136919 - RNA, 19 nt, Human
agcagugccugguucugag

SEQ ID NO: 136920 - RNA, 30 nt, Human
ugcuguccccuccccucuguuuacaucucc

SEQ ID NO: 136921 - RNA, 24 nt, Human
ggcuauuuuugccaccugccuugg

SEQ ID NO: 136922 - RNA, 19 nt, Human
uguuucuugagucuccugu

SEQ ID NO: 136923 - RNA, 23 nt, Human
cgcucccuccccagcaggcacag

SEQ ID NO: 136924 - RNA, 25 nt, Human
cgcugacccugggccuggaggggga

SEQ ID NO: 136925 - RNA, 19 nt, Human
gaaagagaacuacuaagga

SEQ ID NO: 136926 - RNA, 26 nt, Human
gaagugaggggacgaagccuuagagg

SEQ ID NO: 136927 - RNA, 25 nt, Human
gcugucccucauguugaauuuucuc

SEQ ID NO: 136928 - RNA, 21 nt, Human
aacugauacuucacuacuuua

SEQ ID NO: 136929 - RNA, 21 nt, Human
ugacuccuuugagccguuugg

SEQ ID NO: 136930 - RNA, 25 nt, Human
agcaacacagagcugaaaggaagac

SEQ ID NO: 136931 - RNA, 27 nt, Human
uuuggcaugacuuaagaggaagggcag

SEQ ID NO: 136932 - RNA, 22 nt, Human
gggauuacaauugugagccacc

SEQ ID NO: 136933 - RNA, 18 nt, Human
ccaugucuacaacacaga

SEQ ID NO: 136934 - RNA, 22 nt, Human
gcgucccagagucucacucugc

SEQ ID NO: 136935 - RNA, 22 nt, Human
ccagguacugagggacaaguag

SEQ ID NO: 136936 - RNA, 27 nt, Human
cagcuccuaucugcaaacuguguucac

SEQ ID NO: 136937 - RNA, 26 nt, Human
ugcagggcgaagagcaggcggcgagc

SEQ ID NO: 136938 - RNA, 24 nt, Human
augagccugaacugguugugcaga

SEQ ID NO: 136939 - RNA, 21 nt, Human
acagugagcaaagauugugcc

SEQ ID NO: 136940 - RNA, 24 nt, Human
ggccagaggugccaacauggggaa

SEQ ID NO: 136941 - RNA, 22 nt, Human
gggccuuuuagaaaccucauug

SEQ ID NO: 136942 - RNA, 26 nt, Human
guucuuucuuuuucucacuaucugaa

SEQ ID NO: 136943 - RNA, 21 nt, Human
gauuuuuagagugggaagaag

SEQ ID NO: 136944 - RNA, 27 nt, Human
caugucccagucacugcagcaacgccu

SEQ ID NO: 136945 - RNA, 24 nt, Human
ugcagccgccuccaagucugugcg

SEQ ID NO: 136946 - RNA, 18 nt, Human
uacccuuuauuucuucug

SEQ ID NO: 136947 - RNA, 27 nt, Human
uugcuucugucccaagaggcacuagcu

SEQ ID NO: 136948 - RNA, 27 nt, Human
cucuuccuucuccuccuccauccccag

SEQ ID NO: 136949 - RNA, 27 nt, Human
ucagcacuugaccgaaauaccaaaaau

SEQ ID NO: 136950 - RNA, 21 nt, Human
gcagcuucagcaccugcccca

SEQ ID NO: 136951 - RNA, 21 nt, Human
cauguuuguuagccagcacuu

SEQ ID NO: 136952 - RNA, 20 nt, Human
uguucaucugugaaaugaag

SEQ ID NO: 136953 - RNA, 24 nt, Human
gccaugaaacuacaggccgugaug

SEQ ID NO: 136954 - RNA, 26 nt, Human
ggugcauuaaggaaacuaaaagcacc

SEQ ID NO: 136955 - RNA, 24 nt, Human
ccgucaccucucccuccucagcuc

SEQ ID NO: 136956 - RNA, 24 nt, Human
agcugccugcacucugucucucca

SEQ ID NO: 136957 - RNA, 22 nt, Human
cuccugaggcugugggccacag

SEQ ID NO: 136958 - RNA, 27 nt, Human
cccucauucucauuccugggcagcccu

SEQ ID NO: 136959 - RNA, 23 nt, Human
cgcauuucucaugcuucuucuca

SEQ ID NO: 136960 - RNA, 27 nt, Human
ccuuucccaggcaaucccuccugugcu

SEQ ID NO: 136961 - RNA, 20 nt, Human
agcucaggcuggagcaggua

SEQ ID NO: 136962 - RNA, 21 nt, Human
guuuuuaaacaaagcugcuua

SEQ ID NO: 136963 - RNA, 25 nt, Human
guaugcgggagacccuuccaccuca

SEQ ID NO: 136964 - RNA, 22 nt, Human
cuaagagaacagccagaugguu

SEQ ID NO: 136965 - RNA, 17 nt, Human
ggaauuucaugaugauu

SEQ ID NO: 136966 - RNA, 22 nt, Human
acaggacucccccaucuugcug

SEQ ID NO: 136967 - RNA, 21 nt, Human
cccacccccaaagaccugccu

SEQ ID NO: 136968 - RNA, 21 nt, Human
guuuggauuugcaaagccaau

SEQ ID NO: 136969 - RNA, 22 nt, Human
cagaggcagagccugagucacc

SEQ ID NO: 136970 - RNA, 19 nt, Human
ggccucucuggaacucugc

SEQ ID NO: 136971 - RNA, 27 nt, Human
ggaggcugagguggcugcaggagcucg

SEQ ID NO: 136972 - RNA, 24 nt, Human
aauaggggcacacacagaugauuc

SEQ ID NO: 136973 - RNA, 22 nt, Human
guuucugcuacuuuagggaauu

SEQ ID NO: 136974 - RNA, 23 nt, Human
cacaucccaugagaguagagggc

SEQ ID NO: 136975 - RNA, 26 nt, Human
ccccucggggauaugacacaugccca

SEQ ID NO: 136976 - RNA, 22 nt, Human
ggauuggucuugagaacacugu

SEQ ID NO: 136977 - RNA, 23 nt, Human
aacugugggacacagauguggaa

SEQ ID NO: 136978 - RNA, 20 nt, Human
aauauuuuguaacaaaaaga

SEQ ID NO: 136979 - RNA, 27 nt, Human
gcuccaggcugaacggcucgggccacu

SEQ ID NO: 136980 - RNA, 21 nt, Human
agaauugaaaaauugguuugu

SEQ ID NO: 136981 - RNA, 21 nt, Human
gugucaucugaacaauuucca

SEQ ID NO: 136982 - RNA, 22 nt, Human
gcaauuccuuuugauucuuuuu

SEQ ID NO: 136983 - RNA, 23 nt, Human
ccuuaugcaagagaccucagucc

SEQ ID NO: 136984 - RNA, 25 nt, Human
ccauagccacaccacaggauuuccu

SEQ ID NO: 136985 - RNA, 31 nt, Human
cuuccuccugaagccucugcccugccucccu

SEQ ID NO: 136986 - RNA, 23 nt, Human
gaccuugugauccacccaccucg

SEQ ID NO: 136987 - RNA, 21 nt, Human
gcugacguauuacaaaacaga

SEQ ID NO: 136988 - RNA, 22 nt, Human
aacagguucuuaaaaaggauca

SEQ ID NO: 136989 - RNA, 21 nt, Human
gggccaugcagcuaacccacc

SEQ ID NO: 136990 - RNA, 21 nt, Human
ggauucugguucugacagggc

SEQ ID NO: 136991 - RNA, 20 nt, Human
gauacuggcagauugcagug

SEQ ID NO: 136992 - RNA, 24 nt, Human
aaauguucauuucuccugguaccu

SEQ ID NO: 136993 - RNA, 22 nt, Human
uugcccagugugggaguugguu

SEQ ID NO: 136994 - RNA, 17 nt, Human
aggggaggaggagaagc

SEQ ID NO: 136995 - RNA, 22 nt, Human
caaaacugugcagcuuccugaa

SEQ ID NO: 136996 - RNA, 23 nt, Human
ccgggacuccggccgcagugucg

SEQ ID NO: 136997 - RNA, 24 nt, Human
gaagaccagccucugaaaccuacu

SEQ ID NO: 136998 - RNA, 22 nt, Human
gcucacaccuguaaucucagca

SEQ ID NO: 136999 - RNA, 22 nt, Human
gcucacacuuguaaucccagca

SEQ ID NO: 137000 - RNA, 27 nt, Human
cagucucucauuugguaaacagaaagc

SEQ ID NO: 137001 - RNA, 21 nt, Human
gugccaagacguugcugcuuc

SEQ ID NO: 137002 - RNA, 21 nt, Human
ccgcaaagcuacaacgaugga

SEQ ID NO: 137003 - RNA, 20 nt, Human
uccaaguguccauccagaga

SEQ ID NO: 137004 - RNA, 20 nt, Human
ccugaaagagagcaagaaca

SEQ ID NO: 137005 - RNA, 26 nt, Human
ccuccaggauuauuucucugucagcc

SEQ ID NO: 137006 - RNA, 23 nt, Human
caguguuagcacaaacugagcag

SEQ ID NO: 137007 - RNA, 22 nt, Human
uuaagacuugcccaagucccag

SEQ ID NO: 137008 - RNA, 27 nt, Human
cccaacaauugugugaauuaauuucua

SEQ ID NO: 137009 - RNA, 27 nt, Human
ugggaggggauaagguggcagaaggaa

SEQ ID NO: 137010 - RNA, 22 nt, Human
ccaucauaaccauugaauagca

SEQ ID NO: 137011 - RNA, 22 nt, Human
cugacacaggaaaaugaacuua

SEQ ID NO: 137012 - RNA, 18 nt, Human
aggcaaggauuucacaga

SEQ ID NO: 137013 - RNA, 25 nt, Human
gaggccuccugaggccaggaacgug

SEQ ID NO: 137014 - RNA, 20 nt, Human
uucaaacaagagaaaguaac

SEQ ID NO: 137015 - RNA, 20 nt, Human
uccucucaaauucagcucug

SEQ ID NO: 137016 - RNA, 22 nt, Human
gacuaucaaaauacauguaugu

SEQ ID NO: 137017 - RNA, 24 nt, Human
agggccaccugcaggacccugucc

SEQ ID NO: 137018 - RNA, 21 nt, Human
accacaggcugguguguaggu

SEQ ID NO: 137019 - RNA, 20 nt, Human
cacuaccccuugauuuucca

SEQ ID NO: 137020 - RNA, 25 nt, Human
ugguggcagucaccuguagucccag

SEQ ID NO: 137021 - RNA, 22 nt, Human
auccugccucagcuguguggcc

SEQ ID NO: 137022 - RNA, 20 nt, Human
ucagaaaagaaggcugcaaa

SEQ ID NO: 137023 - RNA, 26 nt, Human
aggagggagacugugguaggggcagg

SEQ ID NO: 137024 - RNA, 22 nt, Human
caaaguuaaaguuucucagggu

SEQ ID NO: 137025 - RNA, 23 nt, Human
gggcuggugggacaguggugaca

SEQ ID NO: 137026 - RNA, 21 nt, Human
uacuuccugggucaagugcua

SEQ ID NO: 137027 - RNA, 26 nt, Human
ggucugcacugcaacuucuguauccu

SEQ ID NO: 137028 - RNA, 23 nt, Human
uguccuuguugagaaucauagag

SEQ ID NO: 137029 - RNA, 27 nt, Human
ccauuucucccugucugucccaugggc

SEQ ID NO: 137030 - RNA, 21 nt, Human
cugcauuccagccugggcgaa

SEQ ID NO: 137031 - RNA, 22 nt, Human
cugaucugagucugccugcagc

SEQ ID NO: 137032 - RNA, 26 nt, Human
cugccucugccugcauucugccgugu

SEQ ID NO: 137033 - RNA, 24 nt, Human
gcuccugaucuuccugaagaucuc

SEQ ID NO: 137034 - RNA, 19 nt, Human
gccgccccugacagcugcc

SEQ ID NO: 137035 - RNA, 23 nt, Human
acugugguucuucaagcaauggg

SEQ ID NO: 137036 - RNA, 23 nt, Human
gccuguaaagcucucagcauugg

SEQ ID NO: 137037 - RNA, 19 nt, Human
gugggucacccacucugga

SEQ ID NO: 137038 - RNA, 21 nt, Human
aucuuuaggaaauggaaaugu

SEQ ID NO: 137039 - RNA, 22 nt, Human
cuugacuacaaaacagagcugu

SEQ ID NO: 137040 - RNA, 22 nt, Human
agauuacuucugacauuccauu

SEQ ID NO: 137041 - RNA, 24 nt, Human
guuuuccccaaccucuuacacccu

SEQ ID NO: 137042 - RNA, 23 nt, Human
agcccagccugagccagcacuug

SEQ ID NO: 137043 - RNA, 28 nt, Human
uccaagucugguacaacauagcaaagag

SEQ ID NO: 137044 - RNA, 21 nt, Human
cuuaaccuugucaauagguuc

SEQ ID NO: 137045 - RNA, 26 nt, Human
acauauuuaacugaaacaaguuuuac

SEQ ID NO: 137046 - RNA, 21 nt, Human
aaaacagcaacuuguuugcua

SEQ ID NO: 137047 - RNA, 21 nt, Human
ugcuggagaaucugguaaaag

SEQ ID NO: 137048 - RNA, 25 nt, Human
cacccaggcugagggugccuuugug

SEQ ID NO: 137049 - RNA, 24 nt, Human
uuuuuuccucuucagucucccagu

SEQ ID NO: 137050 - RNA, 20 nt, Human
gcaacaaaauacauucuuuu

SEQ ID NO: 137051 - RNA, 23 nt, Human
gccacaacaccagccccacuucu

SEQ ID NO: 137052 - RNA, 20 nt, Human
guuuauuaugcaacucugga

SEQ ID NO: 137053 - RNA, 22 nt, Human
ggccuccugaguggcugggauu

SEQ ID NO: 137054 - RNA, 24 nt, Human
aaaaguuagguaagacacuuuuuu

SEQ ID NO: 137055 - RNA, 24 nt, Human
auaauuccuuauauccugcuuuug

SEQ ID NO: 137056 - RNA, 20 nt, Human
auaaaugcacggcuuuaccu

SEQ ID NO: 137057 - RNA, 27 nt, Human
ugccagagagauaaaauuuuugcucaa

SEQ ID NO: 137058 - RNA, 22 nt, Human
ucucaggguguucuuguccuca

SEQ ID NO: 137059 - RNA, 25 nt, Human
cagccuauuucccgccuccauuuga

SEQ ID NO: 137060 - RNA, 28 nt, Human
uuuuugugaugaaaaggcagcauuugaa

SEQ ID NO: 137061 - RNA, 27 nt, Human
gucacccaggcuggagugcaaugggca

SEQ ID NO: 137062 - RNA, 21 nt, Human
uucuacaaaucggcauuugga

SEQ ID NO: 137063 - RNA, 23 nt, Human
cagguucugguuggacaaguuua

SEQ ID NO: 137064 - RNA, 26 nt, Human
ccagcagaagauagauaauaugaccu

SEQ ID NO: 137065 - RNA, 26 nt, Human
ccuuucucuccuggcucgggguaaaa

SEQ ID NO: 137066 - RNA, 26 nt, Human
gugggaggggagcagggcacagggga

SEQ ID NO: 137067 - RNA, 22 nt, Human
cuucagccucaaguucugaggu

SEQ ID NO: 137068 - RNA, 25 nt, Human
ugugaugacaagauggcugacaguc

SEQ ID NO: 137069 - RNA, 24 nt, Human
uuuggggucaaaugcuagaaaaau

SEQ ID NO: 137070 - RNA, 26 nt, Human
ugggagguggugguggguggcggugg

SEQ ID NO: 137071 - RNA, 21 nt, Human
cguccuggggaaggcgcugag

SEQ ID NO: 137072 - RNA, 27 nt, Human
uuugagaggcugaggcaggaagauagc

SEQ ID NO: 137073 - RNA, 25 nt, Human
ccuugacuggagcgagccucgcaca

SEQ ID NO: 137074 - RNA, 23 nt, Human
cauuuucccaaugagcaguguca

SEQ ID NO: 137075 - RNA, 26 nt, Human
uuggaaggcgccuucaacagccggac

SEQ ID NO: 137076 - RNA, 21 nt, Human
aauugauuugcuuuacaauca

SEQ ID NO: 137077 - RNA, 24 nt, Human
acucuguggagaauaaagcaccua

SEQ ID NO: 137078 - RNA, 25 nt, Human
ugccucaggccuaagaagcacucuc

SEQ ID NO: 137079 - RNA, 22 nt, Human
gaacccaggagucagagguuuc

SEQ ID NO: 137080 - RNA, 27 nt, Human
ccauuguacuccagccugggcaauaag

SEQ ID NO: 137081 - RNA, 21 nt, Human
cgcaggagagagucuuaccuc

SEQ ID NO: 137082 - RNA, 22 nt, Human
cauacuucguggagcccagcga

SEQ ID NO: 137083 - RNA, 25 nt, Human
uuacuuugccuuucaugagauuacg

SEQ ID NO: 137084 - RNA, 24 nt, Human
agcaugccguucugcaccuaccca

SEQ ID NO: 137085 - RNA, 22 nt, Human
cugcuggugauccucagccgga

SEQ ID NO: 137086 - RNA, 21 nt, Human
uucucaguugcgcuaaucaca

SEQ ID NO: 137087 - RNA, 22 nt, Human
ucaguucuuccuccaccuccac

SEQ ID NO: 137088 - RNA, 23 nt, Human
ccaucacaccuggcccuagugac

SEQ ID NO: 137089 - RNA, 20 nt, Human
caggccugugcccagcaugc

SEQ ID NO: 137090 - RNA, 22 nt, Human
acuggcacuaucuuggcucacu

SEQ ID NO: 137091 - RNA, 24 nt, Human
uaggagguggcuccagcagaggaa

SEQ ID NO: 137092 - RNA, 22 nt, Human
cucaaccuucggaguagcuggg

SEQ ID NO: 137093 - RNA, 25 nt, Human
gaauaccuaaggauaacaccgcuuu

SEQ ID NO: 137094 - RNA, 21 nt, Human
cuucuccaaucaagcacuugg

SEQ ID NO: 137095 - RNA, 26 nt, Human
gcgugugucucagcaccgcuaucuca

SEQ ID NO: 137096 - RNA, 23 nt, Human
ggugaaaacagggccagcagacu

SEQ ID NO: 137097 - RNA, 27 nt, Human
gggagagaaggaaguggcuaaaacauu

SEQ ID NO: 137098 - RNA, 22 nt, Human
accugugaucccagcacuuugg

SEQ ID NO: 137099 - RNA, 27 nt, Human
cccagacugaagagcaggugagcaaaa

SEQ ID NO: 137100 - RNA, 23 nt, Human
ugcucccucuccccucaugcucc

SEQ ID NO: 137101 - RNA, 19 nt, Human
ucucucugcucaucaugcc

SEQ ID NO: 137102 - RNA, 25 nt, Human
gagagugaaggagcgaggaggcgag

SEQ ID NO: 137103 - RNA, 22 nt, Human
uccagcaccuuuguaaugcaua

SEQ ID NO: 137104 - RNA, 20 nt, Human
gguaguuucaguccaucaca

SEQ ID NO: 137105 - RNA, 22 nt, Human
aaguuaaaucacuagaaauuua

SEQ ID NO: 137106 - RNA, 23 nt, Human
uaugaauaauuauguuuaccuca

SEQ ID NO: 137107 - RNA, 24 nt, Human
ccucagcugcugucacaaauaccc

SEQ ID NO: 137108 - RNA, 22 nt, Human
aagcuguuugcuuuuucaggcu

SEQ ID NO: 137109 - RNA, 22 nt, Human
uauccagucauuguaacacugu

SEQ ID NO: 137110 - RNA, 26 nt, Human
acacagucuucacugugcugcagcca

SEQ ID NO: 137111 - RNA, 21 nt, Human
cgggcguggaggucgcggcgg

SEQ ID NO: 137112 - RNA, 25 nt, Human
ggaagcagagguugcaguaagcuga

SEQ ID NO: 137113 - RNA, 26 nt, Human
ccgucgggggccgcucgccagcgucg

SEQ ID NO: 137114 - RNA, 26 nt, Human
gauguucuuccccuguccauuaccau

SEQ ID NO: 137115 - RNA, 26 nt, Human
ccagaaaguguuuaacgguuuuagcu

SEQ ID NO: 137116 - RNA, 23 nt, Human
cagaaaccucauacuucucgggu

SEQ ID NO: 137117 - RNA, 26 nt, Human
ugcccucucugaguucugugcugucu

SEQ ID NO: 137118 - RNA, 22 nt, Human
uucagcucugcugaaaauuucc

SEQ ID NO: 137119 - RNA, 21 nt, Human
cuccaucuuuauagaaggaau

SEQ ID NO: 137120 - RNA, 24 nt, Human
ugcagauaaaauauuuuguuaacu

SEQ ID NO: 137121 - RNA, 25 nt, Human
ccuggacucuccccuggcugguauc

SEQ ID NO: 137122 - RNA, 22 nt, Human
ucccagcccagcccagccuacc

SEQ ID NO: 137123 - RNA, 19 nt, Human
cucuucuuguguuguguuu

SEQ ID NO: 137124 - RNA, 21 nt, Human
aaagccccaaacaacagaaag

SEQ ID NO: 137125 - RNA, 22 nt, Human
guccaaaaacacuuuucuguaa

SEQ ID NO: 137126 - RNA, 27 nt, Human
ccugcagcccucgccugggacagcggc

SEQ ID NO: 137127 - RNA, 31 nt, Human
cuuagggcacugcuagcagggcuucaaccag

SEQ ID NO: 137128 - RNA, 21 nt, Human
gacucaaucuugccugccuuc

SEQ ID NO: 137129 - RNA, 23 nt, Human
acccaugacaacagagagcaucu

SEQ ID NO: 137130 - RNA, 27 nt, Human
gaccagccugggcaacauagcaaaauc

SEQ ID NO: 137131 - RNA, 24 nt, Human
aaguacacacagauaccugacugg

SEQ ID NO: 137132 - RNA, 27 nt, Human
gcugugccugaggcuggcugggggcag

SEQ ID NO: 137133 - RNA, 18 nt, Human
uugggcugggugcagugg

SEQ ID NO: 137134 - RNA, 23 nt, Human
ugcagugagccugucaucgcucc

SEQ ID NO: 137135 - RNA, 19 nt, Human
cuuucucagaucaggauuu

SEQ ID NO: 137136 - RNA, 22 nt, Human
ucuugauaaagcucuguguugg

SEQ ID NO: 137137 - RNA, 20 nt, Human
ucugaggucacagggccugg

SEQ ID NO: 137138 - RNA, 21 nt, Human
cgccuccaggcgguugcggcg

SEQ ID NO: 137139 - RNA, 22 nt, Human
guccuagcccagugcuucucca

SEQ ID NO: 137140 - RNA, 22 nt, Human
augggaaagcaaagcagaaaac

SEQ ID NO: 137141 - RNA, 26 nt, Human
uuugcacuugugcuuucaguuagccu

SEQ ID NO: 137142 - RNA, 24 nt, Human
gagugcugcugccuucggugacua

SEQ ID NO: 137143 - RNA, 23 nt, Human
ugggaggccaaggcaaggggauc

SEQ ID NO: 137144 - RNA, 27 nt, Human
uugggaggcugaggugggagaauugcc

SEQ ID NO: 137145 - RNA, 22 nt, Human
ucucguggccgccccuggacca

SEQ ID NO: 137146 - RNA, 20 nt, Human
uaacaccuccagguucucua

SEQ ID NO: 137147 - RNA, 21 nt, Human
cucucacaccacauuuccuca

SEQ ID NO: 137148 - RNA, 19 nt, Human
uaguccagcacgcccaggg

SEQ ID NO: 137149 - RNA, 22 nt, Human
gggaagaagagaccugggcuug

SEQ ID NO: 137150 - RNA, 25 nt, Human
gccugccccgccacgcuccugggcc

SEQ ID NO: 137151 - RNA, 24 nt, Human
caaugccaccauuguugaugugac

SEQ ID NO: 137152 - RNA, 20 nt, Human
uaguucugcagguugaagcc

SEQ ID NO: 137153 - RNA, 19 nt, Human
guguguagagacgggggau

SEQ ID NO: 137154 - RNA, 26 nt, Human
uggcuccugggcugggacaagugagg

SEQ ID NO: 137155 - RNA, 22 nt, Human
caggauuacaggcaugagccac

SEQ ID NO: 137156 - RNA, 26 nt, Human
agcaaagaguuucagggcacuggcga

SEQ ID NO: 137157 - RNA, 22 nt, Human
uccucaagguagaaaugucuau

SEQ ID NO: 137158 - RNA, 24 nt, Human
uuugccugcacucuugccugcugc

SEQ ID NO: 137159 - RNA, 21 nt, Human
gacuucugacagcucuaccuc

SEQ ID NO: 137160 - RNA, 25 nt, Human
aauuuuaaaaauacuuccucauagg

SEQ ID NO: 137161 - RNA, 27 nt, Human
ccccaaaacaugcacccuggacuucuc

SEQ ID NO: 137162 - RNA, 22 nt, Human
ucaaaaugcuggcauuacaggu

SEQ ID NO: 137163 - RNA, 21 nt, Human
uaguugcuugcuaauauuucc

SEQ ID NO: 137164 - RNA, 23 nt, Human
augggaggaggagaaaaagcggu

SEQ ID NO: 137165 - RNA, 21 nt, Human
uaaauauucuucuuuaccuuu

SEQ ID NO: 137166 - RNA, 23 nt, Human
agacccauuuggcaagagguugu

SEQ ID NO: 137167 - RNA, 15 nt, Human
uacucagcuaaugcc

SEQ ID NO: 137168 - RNA, 22 nt, Human
caccauuguacuccagccuggg

SEQ ID NO: 137169 - RNA, 18 nt, Human
ggucucucaaccaggcau

SEQ ID NO: 137170 - RNA, 27 nt, Human
ggccagcgcugcaaccuccuucggcuu

SEQ ID NO: 137171 - RNA, 24 nt, Human
cggugagcuuccugcagccugugg

SEQ ID NO: 137172 - RNA, 18 nt, Human
ccugauuucaucaaguua

SEQ ID NO: 137173 - RNA, 22 nt, Human
ccauucucucacaucccgugcg

SEQ ID NO: 137174 - RNA, 21 nt, Human
aagaucuuugcaugagguaaa

SEQ ID NO: 137175 - RNA, 24 nt, Human
ucauccaggaacauuggcgcggga

SEQ ID NO: 137176 - RNA, 21 nt, Human
ccuguugccccugccugccca

SEQ ID NO: 137177 - RNA, 30 nt, Human
uguggaguccuguccugccucagggcuuuu

SEQ ID NO: 137178 - RNA, 27 nt, Human
cuggagugcuauggugcaauuuuuguu

SEQ ID NO: 137179 - RNA, 21 nt, Human
aaacuacuagaugugaacuug

SEQ ID NO: 137180 - RNA, 22 nt, Human
ggaauuuuggucccucagugac

SEQ ID NO: 137181 - RNA, 25 nt, Human
uucuucugauguucauuauggugcu

SEQ ID NO: 137182 - RNA, 25 nt, Human
cagagggagaggccagagaagcugc

SEQ ID NO: 137183 - RNA, 22 nt, Human
ccacagugcugggauuacaggc

SEQ ID NO: 137184 - RNA, 20 nt, Human
gcagcuggcaggaguggggu

SEQ ID NO: 137185 - RNA, 21 nt, Human
gcuagcccuagaguacggagc

SEQ ID NO: 137186 - RNA, 19 nt, Human
cuugcccaggguguguuug

SEQ ID NO: 137187 - RNA, 22 nt, Human
cugaacuuuuaaugaacuguga

SEQ ID NO: 137188 - RNA, 27 nt, Human
ucccagccauggcagauuccuccgggc

SEQ ID NO: 137189 - RNA, 25 nt, Human
ucaguccuuccacacuuccaccccc

SEQ ID NO: 137190 - RNA, 22 nt, Human
gauaauacuuccaaauuuuaug

SEQ ID NO: 137191 - RNA, 23 nt, Human
gaacaaacagacaaauuagcuag

SEQ ID NO: 137192 - RNA, 21 nt, Human
ugucccucuucuuaguggaaa

SEQ ID NO: 137193 - RNA, 24 nt, Human
cccaccccaccuccacucccaccu

SEQ ID NO: 137194 - RNA, 21 nt, Human
aaaaauacugcuucacugucu

SEQ ID NO: 137195 - RNA, 23 nt, Human
ccugcugcccacucuccugcugc

SEQ ID NO: 137196 - RNA, 23 nt, Human
uaggcagcagcaggcugaaggga

SEQ ID NO: 137197 - RNA, 21 nt, Human
uacucucuuaaagaagguggg

SEQ ID NO: 137198 - RNA, 20 nt, Human
cugaggcaaaaacugcuuaa

SEQ ID NO: 137199 - RNA, 21 nt, Human
ccccgcagcagcgccuccucc

SEQ ID NO: 137200 - RNA, 27 nt, Human
uccuuccagauccuggguacugaaagc

SEQ ID NO: 137201 - RNA, 22 nt, Human
ccgucugucugucgcccuucuc

SEQ ID NO: 137202 - RNA, 21 nt, Human
auuuuaauuuucaucauucca

SEQ ID NO: 137203 - RNA, 25 nt, Human
ucaauuucuuaggcuggagugcagu

SEQ ID NO: 137204 - RNA, 19 nt, Human
ccagcccugucccugccac

SEQ ID NO: 137205 - RNA, 18 nt, Human
guaugugcuccaaaaccu

SEQ ID NO: 137206 - RNA, 27 nt, Human
agggaaagggaggggggcaugugaggg

SEQ ID NO: 137207 - RNA, 23 nt, Human
ccuuccugcaaccuuugcggcuc

SEQ ID NO: 137208 - RNA, 24 nt, Human
uuuaauaacauguaauucugcuca

SEQ ID NO: 137209 - RNA, 25 nt, Human
ggagcuguuggccugggugggcagg

SEQ ID NO: 137210 - RNA, 24 nt, Human
gcucagccuguuucucucugcccu

SEQ ID NO: 137211 - RNA, 27 nt, Human
cugggcccuguccagggcagugagucc

SEQ ID NO: 137212 - RNA, 23 nt, Human
gaguaggccucuuaauuuauaau

SEQ ID NO: 137213 - RNA, 25 nt, Human
ugccuccaggaggugagcccugggu

SEQ ID NO: 137214 - RNA, 21 nt, Human
acuaguaacagcaggccuuuu

SEQ ID NO: 137215 - RNA, 22 nt, Human
agccuccugggcauguuugucu

SEQ ID NO: 137216 - RNA, 25 nt, Human
ucaccacccuccaaguccucugacc

SEQ ID NO: 137217 - RNA, 27 nt, Human
ccuuugccucugucuagcuuaaaccua

SEQ ID NO: 137218 - RNA, 23 nt, Human
aggacagcguaggccuuuuccug

SEQ ID NO: 137219 - RNA, 17 nt, Human
auuuuucugaauaccuc

SEQ ID NO: 137220 - RNA, 20 nt, Human
ugcugugcucugggcgccag

SEQ ID NO: 137221 - RNA, 22 nt, Human
gauggaguuucaccauguugcc

SEQ ID NO: 137222 - RNA, 25 nt, Human
cccaaggagcugcagcugaacugca

SEQ ID NO: 137223 - RNA, 25 nt, Human
ugggccauuccaguacuuccugcag

SEQ ID NO: 137224 - RNA, 21 nt, Human
aggcccuuuuugagccuguuu

SEQ ID NO: 137225 - RNA, 21 nt, Human
cguuuacuguuauuguauuua

SEQ ID NO: 137226 - RNA, 20 nt, Human
aacugugaggguaaaggcua

SEQ ID NO: 137227 - RNA, 24 nt, Human
uccagucucugccuaauuuuuagu

SEQ ID NO: 137228 - RNA, 28 nt, Human
ugagccuggccucacacgcuccuagagg

SEQ ID NO: 137229 - RNA, 22 nt, Human
agguucuugagcuuaucuccca

SEQ ID NO: 137230 - RNA, 27 nt, Human
cuggauucucugggucuauguaggccc

SEQ ID NO: 137231 - RNA, 21 nt, Human
ggagugugugauguguuucca

SEQ ID NO: 137232 - RNA, 24 nt, Human
aggucgggucgccguccagccugc

SEQ ID NO: 137233 - RNA, 27 nt, Human
cuucugagccccuuccccuguccugag

SEQ ID NO: 137234 - RNA, 19 nt, Human
gacuccugcucucuaucca

SEQ ID NO: 137235 - RNA, 20 nt, Human
uggggaaggcaggaggcaga

SEQ ID NO: 137236 - RNA, 23 nt, Human
uucugcacuucgcacuugagaga

SEQ ID NO: 137237 - RNA, 30 nt, Human
gcgggcacugaagcugcggcuugcgguuca

SEQ ID NO: 137238 - RNA, 24 nt, Human
agaagcugcucuccacuugcuuua

SEQ ID NO: 137239 - RNA, 26 nt, Human
gcagccgccucgccaugaagcugcug

SEQ ID NO: 137240 - RNA, 27 nt, Human
cuguggcuggggaggcccuggcagcag

SEQ ID NO: 137241 - RNA, 20 nt, Human
ucaacuugcucucuuuccca

SEQ ID NO: 137242 - RNA, 27 nt, Human
ucugccuggccuguuuggacuuugggg

SEQ ID NO: 137243 - RNA, 22 nt, Human
ucuugggaaaacagcgucuucc

SEQ ID NO: 137244 - RNA, 19 nt, Human
acagacagaagaggggucc

SEQ ID NO: 137245 - RNA, 26 nt, Human
gccuguaaucccaacuacuugggagg

SEQ ID NO: 137246 - RNA, 27 nt, Human
ccuuucucgcuccccccauccugggcu

SEQ ID NO: 137247 - RNA, 27 nt, Human
uuuuuaaguucauuaaagcagcaaauu

SEQ ID NO: 137248 - RNA, 20 nt, Human
cuuuauggacaacuacagca

SEQ ID NO: 137249 - RNA, 29 nt, Human
cccagaaacaacaggggaaacuagaguuc

SEQ ID NO: 137250 - RNA, 20 nt, Human
cgggagggaggaggagcaga

SEQ ID NO: 137251 - RNA, 18 nt, Human
gagagauguggaaagagc

SEQ ID NO: 137252 - RNA, 22 nt, Human
ggaaaggaagaaaggcagcuuc

SEQ ID NO: 137253 - RNA, 21 nt, Human
gguaggaaagggcaagucuuu

SEQ ID NO: 137254 - RNA, 22 nt, Human
aaaagguauugaaacauuuuug

SEQ ID NO: 137255 - RNA, 22 nt, Human
aagugaucccuggucauccuaa

SEQ ID NO: 137256 - RNA, 22 nt, Human
gcauaugcuucugaugguguca

SEQ ID NO: 137257 - RNA, 19 nt, Human
ugaugccacuuugcagcua

SEQ ID NO: 137258 - RNA, 22 nt, Human
auccuguggauuuaaaaacucu

SEQ ID NO: 137259 - RNA, 22 nt, Human
aguggcgagaucucagcucacu

SEQ ID NO: 137260 - RNA, 20 nt, Human
ccccucacagccccagggag

SEQ ID NO: 137261 - RNA, 21 nt, Human
gccccaggugugggguccgcu

SEQ ID NO: 137262 - RNA, 23 nt, Human
ugcugaccacugacucagcucug

SEQ ID NO: 137263 - RNA, 21 nt, Human
aacugcucccauuucugggaa

SEQ ID NO: 137264 - RNA, 21 nt, Human
gcuaccucugugaacugaggg

SEQ ID NO: 137265 - RNA, 20 nt, Human
auuugcuguuugcauggugg

SEQ ID NO: 137266 - RNA, 20 nt, Human
cgcccaggcuggggugcagu

SEQ ID NO: 137267 - RNA, 26 nt, Human
cugccucucccucugccucccucaac

SEQ ID NO: 137268 - RNA, 26 nt, Human
auucuucaauuaggacacaaaccaga

SEQ ID NO: 137269 - RNA, 27 nt, Human
cacugcacuugccaccugagucacauu

SEQ ID NO: 137270 - RNA, 22 nt, Human
cagaauggagucuuuucuguua

SEQ ID NO: 137271 - RNA, 27 nt, Human
uucagcagguuaaagaugguugcagcu

SEQ ID NO: 137272 - RNA, 27 nt, Human
ggagagggagagggggcugaggaggua

SEQ ID NO: 137273 - RNA, 22 nt, Human
aucagccugggcaacacaguga

SEQ ID NO: 137274 - RNA, 22 nt, Human
cucugggccuguugcuccaucu

SEQ ID NO: 137275 - RNA, 23 nt, Human
cugucaccaugccggccugcugc

SEQ ID NO: 137276 - RNA, 24 nt, Human
aacgcaacuguuucuacuucccca

SEQ ID NO: 137277 - RNA, 22 nt, Human
gcgugagccacugugcccggcc

SEQ ID NO: 137278 - RNA, 22 nt, Human
gcaugagccacugugcccagcc

SEQ ID NO: 137279 - RNA, 22 nt, Human
cugcagcuuccccauuugcgcc

SEQ ID NO: 137280 - RNA, 26 nt, Human
cagggugggcuucguucuuguggaaa

SEQ ID NO: 137281 - RNA, 21 nt, Human
ccccgaccccaucugccuccu

SEQ ID NO: 137282 - RNA, 20 nt, Human
guccaggcuggagugcaaua

SEQ ID NO: 137283 - RNA, 22 nt, Human
cagauaccagccuuccccagcg

SEQ ID NO: 137284 - RNA, 21 nt, Human
gaucguuguuuacaguguaug

SEQ ID NO: 137285 - RNA, 25 nt, Human
acuacaaccuccaugaccuugagac

SEQ ID NO: 137286 - RNA, 22 nt, Human
cuuugccugcccagucuuugga

SEQ ID NO: 137287 - RNA, 21 nt, Human
uuucccaaggcucccuuccca

SEQ ID NO: 137288 - RNA, 21 nt, Human
ugcacuuguaaaacaggauuu

SEQ ID NO: 137289 - RNA, 23 nt, Human
uaccuuuccauccuuuacuccaa

SEQ ID NO: 137290 - RNA, 23 nt, Human
caaguaacugggauuacaggcau

SEQ ID NO: 137291 - RNA, 19 nt, Human
ugcuguugcugccacugcu

SEQ ID NO: 137292 - RNA, 20 nt, Human
uucuaaaaugccuuuuccca

SEQ ID NO: 137293 - RNA, 22 nt, Human
guucacugcaacuucugccucc

SEQ ID NO: 137294 - RNA, 22 nt, Human
guucacugcaaccucugccuuc

SEQ ID NO: 137295 - RNA, 24 nt, Human
aaccuguccuugcuucucaguuuc

SEQ ID NO: 137296 - RNA, 24 nt, Human
aggacucucugcuccagccucuca

SEQ ID NO: 137297 - RNA, 26 nt, Human
ccucaaaccuguggccacuggcauga

SEQ ID NO: 137298 - RNA, 23 nt, Human
uucacuacuucuuuucuuaguuu

SEQ ID NO: 137299 - RNA, 24 nt, Human
agaaggcaaggccgguguguuuau

SEQ ID NO: 137300 - RNA, 22 nt, Human
ggggcugagucccugcccggac

SEQ ID NO: 137301 - RNA, 28 nt, Human
uauucaggauuuacagugcaguauucac

SEQ ID NO: 137302 - RNA, 26 nt, Human
ccuguagccaucugcacacaccuccg

SEQ ID NO: 137303 - RNA, 18 nt, Human
uuucccuuaguuaagcua

SEQ ID NO: 137304 - RNA, 20 nt, Human
ugcuggccaaucagugucau

SEQ ID NO: 137305 - RNA, 25 nt, Human
cccuggccucucccccuggcugauc

SEQ ID NO: 137306 - RNA, 22 nt, Human
ugcagccugcugcuccagggag

SEQ ID NO: 137307 - RNA, 23 nt, Human
ccaccuuggcccuaaaacagcca

SEQ ID NO: 137308 - RNA, 32 nt, Human
gcuguaacugccaggcucucuuugcccaguug

SEQ ID NO: 137309 - RNA, 24 nt, Human
acauggacucucuguuggccugca

SEQ ID NO: 137310 - RNA, 26 nt, Human
ggaaggcagaggcuggcaccauggug

SEQ ID NO: 137311 - RNA, 19 nt, Human
cccaccccaccugccaccg

SEQ ID NO: 137312 - RNA, 23 nt, Human
cuugcaaauaauguggucucagg

SEQ ID NO: 137313 - RNA, 20 nt, Human
gugauuuaaccagugcuugg

SEQ ID NO: 137314 - RNA, 21 nt, Human
aaagagacauuucagcuguga

SEQ ID NO: 137315 - RNA, 21 nt, Human
gucccuguagcucagucauca

SEQ ID NO: 137316 - RNA, 22 nt, Human
auucggcccagcucgucccggc

SEQ ID NO: 137317 - RNA, 25 nt, Human
gggggaugacucacagcccauccca

SEQ ID NO: 137318 - RNA, 26 nt, Human
ggcacccaggcugugaucuguccugg

SEQ ID NO: 137319 - RNA, 20 nt, Human
uguaaaacaugacauucccu

SEQ ID NO: 137320 - RNA, 25 nt, Human
ggcuccuccuccugucgugggcuca

SEQ ID NO: 137321 - RNA, 21 nt, Human
aggccuggagcguccugcugc

SEQ ID NO: 137322 - RNA, 22 nt, Human
uuaaaccugucuccacugugcc

SEQ ID NO: 137323 - RNA, 21 nt, Human
ugcccucaucaucccagggga

SEQ ID NO: 137324 - RNA, 24 nt, Human
ggccuggguucaagucccaccucu

SEQ ID NO: 137325 - RNA, 26 nt, Human
acugagaccuccagaaaucuauucca

SEQ ID NO: 137326 - RNA, 26 nt, Human
ccagaagaaaugacgcagaagugaaa

SEQ ID NO: 137327 - RNA, 26 nt, Human
cuguugagagauaagguagagcugag

SEQ ID NO: 137328 - RNA, 24 nt, Human
auaccuggcccugagccuuggugu

SEQ ID NO: 137329 - RNA, 24 nt, Human
cccucuuuuuccccuugauggaaa

SEQ ID NO: 137330 - RNA, 22 nt, Human
agccuucaggucuggggccagg

SEQ ID NO: 137331 - RNA, 20 nt, Human
ugugagccaccacacccagc

SEQ ID NO: 137332 - RNA, 25 nt, Human
gcugcuacgagcggugucuccuggg

SEQ ID NO: 137333 - RNA, 20 nt, Human
ggagaauacucacccuucag

SEQ ID NO: 137334 - RNA, 24 nt, Human
agauguuaacaguaaagauggaga

SEQ ID NO: 137335 - RNA, 20 nt, Human
gcugucucugccugccggau

SEQ ID NO: 137336 - RNA, 22 nt, Human
gggccugcaggaccugccugua

SEQ ID NO: 137337 - RNA, 22 nt, Human
gagagugaggcauugagggcca

SEQ ID NO: 137338 - RNA, 18 nt, Human
uggauguaaugcacuuug

SEQ ID NO: 137339 - RNA, 26 nt, Human
cucuugguaaucuuccauccacugcc

SEQ ID NO: 137340 - RNA, 28 nt, Human
gaacggcgugaagccacuggacccucuc

SEQ ID NO: 137341 - RNA, 24 nt, Human
cucgagauuucuuaaauccaauau

SEQ ID NO: 137342 - RNA, 21 nt, Human
guugucuuucccuuggcugau

SEQ ID NO: 137343 - RNA, 21 nt, Human
uuauccaaguagagugcaggc

SEQ ID NO: 137344 - RNA, 22 nt, Human
uucccaucacuguauccauucu

SEQ ID NO: 137345 - RNA, 28 nt, Human
uggauguagaaacaggcuuggagacuua

SEQ ID NO: 137346 - RNA, 22 nt, Human
cagaagcugauaaaaaagcuuu

SEQ ID NO: 137347 - RNA, 24 nt, Human
aggccucuggcccucgguggcugc

SEQ ID NO: 137348 - RNA, 26 nt, Human
guuucugcuucuagagauugagguga

SEQ ID NO: 137349 - RNA, 20 nt, Human
ugguucuacccuuucugccu

SEQ ID NO: 137350 - RNA, 20 nt, Human
ucugggcauugggcauucau

SEQ ID NO: 137351 - RNA, 26 nt, Human
ccagaaacacaucccugucuccaaau

SEQ ID NO: 137352 - RNA, 22 nt, Human
gcaccaagaucuccaacagcca

SEQ ID NO: 137353 - RNA, 23 nt, Human
ucccuccucugcucuccaucaua

SEQ ID NO: 137354 - RNA, 27 nt, Human
ugcuacuuuagggaauuauugacuggg

SEQ ID NO: 137355 - RNA, 27 nt, Human
ugagccaagauugcgcccccugcacuc

SEQ ID NO: 137356 - RNA, 22 nt, Human
aaaugauuaauuaaauagcuuu

SEQ ID NO: 137357 - RNA, 21 nt, Human
agaggcgguuagcaccuauua

SEQ ID NO: 137358 - RNA, 24 nt, Human
gagaucagcaggcacuguacuggg

SEQ ID NO: 137359 - RNA, 27 nt, Human
gcucuaucaccuaggcuggagugcagc

SEQ ID NO: 137360 - RNA, 23 nt, Human
cagggagggaaggggauggaggc

SEQ ID NO: 137361 - RNA, 23 nt, Human
ccccaacauggaaagaaacauca

SEQ ID NO: 137362 - RNA, 19 nt, Human
ugaacaaauccuacucuga

SEQ ID NO: 137363 - RNA, 20 nt, Human
ggcucuagaaagucuugccu

SEQ ID NO: 137364 - RNA, 21 nt, Human
cuuuagacggggcugaaggag

SEQ ID NO: 137365 - RNA, 24 nt, Human
ucugccuuuuagcuucuaaaagga

SEQ ID NO: 137366 - RNA, 22 nt, Human
uggaacagugugccauucuugu

SEQ ID NO: 137367 - RNA, 27 nt, Human
gguggaggagcuuaguaaguggugcua

SEQ ID NO: 137368 - RNA, 21 nt, Human
aucggccaggcuggagugcag

SEQ ID NO: 137369 - RNA, 23 nt, Human
gacaccaggcugcagggggcugg

SEQ ID NO: 137370 - RNA, 27 nt, Human
caggaauauuaaagggauucaggccuc

SEQ ID NO: 137371 - RNA, 22 nt, Human
gcccccagaaucugggcuucuu

SEQ ID NO: 137372 - RNA, 21 nt, Human
ucaguacacuuccugugccau

SEQ ID NO: 137373 - RNA, 21 nt, Human
gcagagcuucguugauggucu

SEQ ID NO: 137374 - RNA, 22 nt, Human
caacaccugggcucaaguggcu

SEQ ID NO: 137375 - RNA, 20 nt, Human
auuuggggagaaugagggag

SEQ ID NO: 137376 - RNA, 21 nt, Human
cacuugaauucaggaggugga

SEQ ID NO: 137377 - RNA, 20 nt, Human
uuaaccucaucuacaagcau

SEQ ID NO: 137378 - RNA, 22 nt, Human
caggcuggagugcaguggagca

SEQ ID NO: 137379 - RNA, 32 nt, Human
ugggucugugguaucugacacuguggacauua

SEQ ID NO: 137380 - RNA, 21 nt, Human
gagaugcaacauacuacuuuu

SEQ ID NO: 137381 - RNA, 21 nt, Human
auugucauuucugaugugcca

SEQ ID NO: 137382 - RNA, 21 nt, Human
ucuuguuccgggacugcagga

SEQ ID NO: 137383 - RNA, 26 nt, Human
uugccaggcuggugcaaaguaauuaa

SEQ ID NO: 137384 - RNA, 21 nt, Human
uugaaaaccuguccagaugcu

SEQ ID NO: 137385 - RNA, 26 nt, Human
gugguaggaacccaggagggacccag

SEQ ID NO: 137386 - RNA, 26 nt, Human
accagcucuggcugggguccgugaag

SEQ ID NO: 137387 - RNA, 21 nt, Human
ggaggaagaaggaaggagagg

SEQ ID NO: 137388 - RNA, 21 nt, Human
uaaugccaguuccagcuucau

SEQ ID NO: 137389 - RNA, 21 nt, Human
gugaaaggagauaggagaagc

SEQ ID NO: 137390 - RNA, 19 nt, Human
uugcaacaggcugggcuuc

SEQ ID NO: 137391 - RNA, 22 nt, Human
ggaaccuguuucuuacagcuuu

SEQ ID NO: 137392 - RNA, 27 nt, Human
cccaggaguuuaaagcugcagugcccu

SEQ ID NO: 137393 - RNA, 21 nt, Human
aaucuagguuguauuuucagu

SEQ ID NO: 137394 - RNA, 25 nt, Human
uugagccuuggaaagguagacaagc

SEQ ID NO: 137395 - RNA, 27 nt, Human
uagaauuuuaagccuuuguugaacugu

SEQ ID NO: 137396 - RNA, 21 nt, Human
ugccaccugcugcugcugcug

SEQ ID NO: 137397 - RNA, 21 nt, Human
ucaugggcucaccugggccca

SEQ ID NO: 137398 - RNA, 28 nt, Human
uaugcauuuaucuucacucugaugaggg

SEQ ID NO: 137399 - RNA, 23 nt, Human
agugcacacuaccuucccaccca

SEQ ID NO: 137400 - RNA, 20 nt, Human
uccaucucuauauaaaaaca

SEQ ID NO: 137401 - RNA, 26 nt, Human
ucggucacauguuuuuccuucagcuu

SEQ ID NO: 137402 - RNA, 20 nt, Human
ugacauuugacauuuggugg

SEQ ID NO: 137403 - RNA, 20 nt, Human
aagugguuugggaaaggagg

SEQ ID NO: 137404 - RNA, 23 nt, Human
agcuucuucccgggagagcagcc

SEQ ID NO: 137405 - RNA, 25 nt, Human
gugggugaaagauggaacuugcugc

SEQ ID NO: 137406 - RNA, 22 nt, Human
cauugcacuccagccuaggcaa

SEQ ID NO: 137407 - RNA, 26 nt, Human
cuugucgcucagccuggagugcagug

SEQ ID NO: 137408 - RNA, 20 nt, Human
ugaggggauggaguuuucaa

SEQ ID NO: 137409 - RNA, 21 nt, Human
uuucauugugaccacucugaa

SEQ ID NO: 137410 - RNA, 21 nt, Human
augggaaacagaauuucaugc

SEQ ID NO: 137411 - RNA, 20 nt, Human
gagcuggccgcggcaccuua

SEQ ID NO: 137412 - RNA, 22 nt, Human
uucguggcauccuuuaggauaa

SEQ ID NO: 137413 - RNA, 26 nt, Human
cugcucccgcuccucugccuccccau

SEQ ID NO: 137414 - RNA, 22 nt, Human
cugaacucgcagggagugcagc

SEQ ID NO: 137415 - RNA, 22 nt, Human
agccagaaaucuauuaguagaa

SEQ ID NO: 137416 - RNA, 27 nt, Human
aggcuacauccccccaccccagcuggu

SEQ ID NO: 137417 - RNA, 25 nt, Human
caucguucccacuccccaucccacu

SEQ ID NO: 137418 - RNA, 24 nt, Human
aggcugagaggcugagaaaucauc

SEQ ID NO: 137419 - RNA, 22 nt, Human
ucuaagauacaguauuuaguaa

SEQ ID NO: 137420 - RNA, 21 nt, Human
agcaauagcauccaaggggcc

SEQ ID NO: 137421 - RNA, 22 nt, Human
aacaucgcccauucucucucca

SEQ ID NO: 137422 - RNA, 26 nt, Human
ccucaccucugugcccagccuggaaa

SEQ ID NO: 137423 - RNA, 21 nt, Human
aauuccauuaagggacccucu

SEQ ID NO: 137424 - RNA, 27 nt, Human
ccucggcccuccuggguuuacuccuug

SEQ ID NO: 137425 - RNA, 28 nt, Human
cacccugcagucuucauccucacucagc

SEQ ID NO: 137426 - RNA, 23 nt, Human
aucagcugauauuaguagcuuug

SEQ ID NO: 137427 - RNA, 23 nt, Human
gcugcugcugccgcugccggguc

SEQ ID NO: 137428 - RNA, 22 nt, Human
uuuaagcgauucuccugccuca

SEQ ID NO: 137429 - RNA, 22 nt, Human
uucaagcgauccuccugccuca

SEQ ID NO: 137430 - RNA, 23 nt, Human
uagaccugcaucuugaggccaca

SEQ ID NO: 137431 - RNA, 25 nt, Human
ccgcuggugacccucugcuucccuc

SEQ ID NO: 137432 - RNA, 23 nt, Human
caguauugaucugacuguggaaa

SEQ ID NO: 137433 - RNA, 26 nt, Human
gcaaugaaacuuuuaauuauuuuucu

SEQ ID NO: 137434 - RNA, 24 nt, Human
caagggcacaaacugcagcuguga

SEQ ID NO: 137435 - RNA, 21 nt, Human
cucugagggcuucccggcccc

SEQ ID NO: 137436 - RNA, 32 nt, Human
caggaccuguuggcagaguugccaggguuaca

SEQ ID NO: 137437 - RNA, 26 nt, Human
cccagucauccugcccagcccugccu

SEQ ID NO: 137438 - RNA, 30 nt, Human
acucaccugaggaagggaaggaagggaaua

SEQ ID NO: 137439 - RNA, 24 nt, Human
uccucagaaaguguauaauaagaa

SEQ ID NO: 137440 - RNA, 22 nt, Human
caugccuugguggggccugugu

SEQ ID NO: 137441 - RNA, 24 nt, Human
gcuguucuucuguucugcagacac

SEQ ID NO: 137442 - RNA, 21 nt, Human
uccugucuuccuuccuccuca

SEQ ID NO: 137443 - RNA, 20 nt, Human
aggcguaggcucacccuggg

SEQ ID NO: 137444 - RNA, 23 nt, Human
uucaggauauuguagaugcacag

SEQ ID NO: 137445 - RNA, 21 nt, Human
guuucauaagcaucuuccugu

SEQ ID NO: 137446 - RNA, 22 nt, Human
caggcuggagugcaaugaugcg

SEQ ID NO: 137447 - RNA, 24 nt, Human
ccgcccaccugccccugccucuca

SEQ ID NO: 137448 - RNA, 30 nt, Human; identical to SEQ ID NO: 6532

SEQ ID NO: 137449 - RNA, 26 nt, Human
gggggcugcaguggauucacuguguc

SEQ ID NO: 137450 - RNA, 26 nt, Human
gccacuucccuuccgcacuuaccacu

SEQ ID NO: 137451 - RNA, 18 nt, Human
acagcccugcacgcccag

SEQ ID NO: 137452 - RNA, 23 nt, Human
cucagggucagcaaccuagugag

SEQ ID NO: 137453 - RNA, 17 nt, Human
cacuccuagcugcucca

SEQ ID NO: 137454 - RNA, 19 nt, Human
gccuugccccuccugcucc

SEQ ID NO: 137455 - RNA, 22 nt, Human
ccaggauugugccauugcacuc

SEQ ID NO: 137456 - RNA, 22 nt, Human
cuucagaaucucaugcuuucug

SEQ ID NO: 137457 - RNA, 28 nt, Human
cuucaguaccaccccucucuccccaccu

SEQ ID NO: 137458 - RNA, 21 nt, Human
uuacagaaaauauagccauga

SEQ ID NO: 137459 - RNA, 23 nt, Human
uagaaggcuggccccugcugcaa

SEQ ID NO: 137460 - RNA, 26 nt, Human
ccugucuugcugucaugaaaucagca

SEQ ID NO: 137461 - RNA, 27 nt, Human
ucccucgggcaggcccagagagccaga

SEQ ID NO: 137462 - RNA, 18 nt, Human
gcuccguugcugaccgcc

SEQ ID NO: 137463 - RNA, 23 nt, Human
accuuuuuaagucauagaccaaa

SEQ ID NO: 137464 - RNA, 24 nt, Human
uaccucuggucuuaucugugauac

SEQ ID NO: 137465 - RNA, 22 nt, Human
agcucacugguuccuucugcag

SEQ ID NO: 137466 - RNA, 25 nt, Human
ugacugcagccuuuggcucaagcuc

SEQ ID NO: 137467 - RNA, 24 nt, Human
uuugcugcucuucaucccauucca

SEQ ID NO: 137468 - RNA, 22 nt, Human
guaccugccacaccacagcugc

SEQ ID NO: 137469 - RNA, 20 nt, Human
aagcagcuggucuggaagaa

SEQ ID NO: 137470 - RNA, 27 nt, Human
uguaauaugacuccuguguucuggacu

SEQ ID NO: 137471 - RNA, 23 nt, Human
cuggccgucccugcaaagagugu

SEQ ID NO: 137472 - RNA, 20 nt, Human
uguggguugaagcacuggac

SEQ ID NO: 137473 - RNA, 23 nt, Human
ucccccacucucucacccaccag

SEQ ID NO: 137474 - RNA, 26 nt, Human
ggcaaagccccaucucuacaaaaaac

SEQ ID NO: 137475 - RNA, 23 nt, Human
agccuccuccugcguccgagccg

SEQ ID NO: 137476 - RNA, 26 nt, Human
ccagcauaaugagauggaaucugcca

SEQ ID NO: 137477 - RNA, 21 nt, Human
uggggaagggaaagacugggg

SEQ ID NO: 137478 - RNA, 23 nt, Human
ccaccucuugucagugcucggcu

SEQ ID NO: 137479 - RNA, 27 nt, Human
aagugggggcggggaagggugcauagc

SEQ ID NO: 137480 - RNA, 22 nt, Human
ccagagucccugaacucucgcu

SEQ ID NO: 137481 - RNA, 24 nt, Human
ugcagcauuccuuucuccagggua

SEQ ID NO: 137482 - RNA, 23 nt, Human
cuggaagggcaggucuggcggcu

SEQ ID NO: 137483 - RNA, 23 nt, Human
acgacaccacugcacuccagccu

SEQ ID NO: 137484 - RNA, 22 nt, Human
gcgaucucggcucacugcaacc

SEQ ID NO: 137485 - RNA, 22 nt, Human
acgaucucagcucacugcaacc

SEQ ID NO: 137486 - RNA, 21 nt, Human
gcccagccccuccucccugcc

SEQ ID NO: 137487 - RNA, 24 nt, Human
ggccuagaucuccucuccuccucc

SEQ ID NO: 137488 - RNA, 22 nt, Human
gucugccuuuaauuuucucuuu

SEQ ID NO: 137489 - RNA, 25 nt, Human
ggcucccuaccccuuccuuuagccc

SEQ ID NO: 137490 - RNA, 23 nt, Human
gggaugggaggggaagggacgga

SEQ ID NO: 137491 - RNA, 23 nt, Human
uuaagccccacggcccugaaaua

SEQ ID NO: 137492 - RNA, 26 nt, Human
ucccauagcugggacuacaggcgccc

SEQ ID NO: 137493 - RNA, 22 nt, Human
cgccaccgcacuccagccuggg

SEQ ID NO: 137494 - RNA, 27 nt, Human
aagaaagaguugcaaaaaacugcauuu

SEQ ID NO: 137495 - RNA, 20 nt, Human
gugauuccauggauugauuc

SEQ ID NO: 137496 - RNA, 28 nt, Human
agccccuaggaguauauuuccgcacuuc

SEQ ID NO: 137497 - RNA, 20 nt, Human
aggagugauugaaccugcuc

SEQ ID NO: 137498 - RNA, 24 nt, Human
uggacuucauuuucaaugaugaac

SEQ ID NO: 137499 - RNA, 22 nt, Human
uacaggcaggcgccaccaggcc

SEQ ID NO: 137500 - RNA, 26 nt, Human
gugagcucgccugaguaugggguggu

SEQ ID NO: 137501 - RNA, 20 nt, Human
guccucugggugguuaugag

SEQ ID NO: 137502 - RNA, 25 nt, Human
gguaaaagucuuuuccacaaaccac

SEQ ID NO: 137503 - RNA, 22 nt, Human
cgaacuccugaccucaagugau

SEQ ID NO: 137504 - RNA, 24 nt, Human
ugcugugucccccgugaugcagcu

SEQ ID NO: 137505 - RNA, 22 nt, Human
aaaaggaacacugguugccuga

SEQ ID NO: 137506 - RNA, 21 nt, Human
ccgcagccuccuccugccuca

SEQ ID NO: 137507 - RNA, 27 nt, Human
cgcugucacucagccuggacgcgcuuc

SEQ ID NO: 137508 - RNA, 24 nt, Human
gcaagcuuucucucauaacguaau

SEQ ID NO: 137509 - RNA, 21 nt, Human
gccugcacagugucccccagg

SEQ ID NO: 137510 - RNA, 23 nt, Human
caguggugcuucaacugguaucu

SEQ ID NO: 137511 - RNA, 26 nt, Human
agaggaagaaaugcuagccuggaagc

SEQ ID NO: 137512 - RNA, 22 nt, Human
agaaagaugaagcuuggagguc

SEQ ID NO: 137513 - RNA, 25 nt, Human
cucuaggauuucugaaaguuacuga

SEQ ID NO: 137514 - RNA, 23 nt, Human
aguuuuugcuuucuguuuugcug

SEQ ID NO: 137515 - RNA, 24 nt, Human
gcccagacagugagggcaggaggg

SEQ ID NO: 137516 - RNA, 22 nt, Human
aggucuccaaaccagacgguga

SEQ ID NO: 137517 - RNA, 23 nt, Human
aaggaagcuuuggaagcagcaag

SEQ ID NO: 137518 - RNA, 21 nt, Human
gauugcgucacugaacuccgg

SEQ ID NO: 137519 - RNA, 22 nt, Human
auacuauauauacaauauauau

SEQ ID NO: 137520 - RNA, 25 nt, Human
uucagauuugccuuauuggcagcuc

SEQ ID NO: 137521 - RNA, 16 nt, Human
ccuaucuccagcggcc

SEQ ID NO: 137522 - RNA, 28 nt, Human
uggaggugggcaggauggagaacagugc

SEQ ID NO: 137523 - RNA, 24 nt, Human
cuccgaaugccuuuuauuuggggg

SEQ ID NO: 137524 - RNA, 19 nt, Human
guaaauguguccacacaac

SEQ ID NO: 137525 - RNA, 21 nt, Human
cuuuccucuucugucaucuca

SEQ ID NO: 137526 - RNA, 21 nt, Human
gccguucagccuuuuccucca

SEQ ID NO: 137527 - RNA, 23 nt, Human
gugggccuugcaagaugggagag

SEQ ID NO: 137528 - RNA, 21 nt, Human
uucaagcaauugucugccuca

SEQ ID NO: 137529 - RNA, 26 nt, Human
cccagccugcugagacuccuccugca

SEQ ID NO: 137530 - RNA, 29 nt, Human
ggacuugggaucagcaggccaggcagguc

SEQ ID NO: 137531 - RNA, 27 nt, Human
cuuaccucucaaccuguccccuccacu

SEQ ID NO: 137532 - RNA, 21 nt, Human
aaagagagcuucucagagccu

SEQ ID NO: 137533 - RNA, 23 nt, Human
ggacucaggcuggggucugcagu

SEQ ID NO: 137534 - RNA, 23 nt, Human
uaguugaggcagggugaguagcu

SEQ ID NO: 137535 - RNA, 19 nt, Human
ucucuaaaccucagggugg

SEQ ID NO: 137536 - RNA, 22 nt, Human
ggguagcugggauuacaagcac

SEQ ID NO: 137537 - RNA, 22 nt, Human
auacaaauugacugagugcagu

SEQ ID NO: 137538 - RNA, 28 nt, Human
auggaguacugggucacagggauuccuc

SEQ ID NO: 137539 - RNA, 23 nt, Human
gcugggcugucucucuccauguu

SEQ ID NO: 137540 - RNA, 17 nt, Human
uugccuccagugcaguc

SEQ ID NO: 137541 - RNA, 21 nt, Human
auuucagaaccaaaagggagg

SEQ ID NO: 137542 - RNA, 20 nt, Human
auuacaguuauaauuuugga

SEQ ID NO: 137543 - RNA, 26 nt, Human
ucucucuccuguggaugcuccuggaa

SEQ ID NO: 137544 - RNA, 27 nt, Human
caggagguggagguugcaguaagcuga

SEQ ID NO: 137545 - RNA, 21 nt, Human
ccugccugagguccccgcugc

SEQ ID NO: 137546 - RNA, 21 nt, Human
gcaaaguguccccggcaagaa

SEQ ID NO: 137547 - RNA, 27 nt, Human
cggugaugaggaaggacuugacugggg

SEQ ID NO: 137548 - RNA, 27 nt, Human
ccagucacugugccagcaggguggcug

SEQ ID NO: 137549 - RNA, 23 nt, Human
uccuguaauuucaugcagcuuug

SEQ ID NO: 137550 - RNA, 21 nt, Human
aaaacaauggugaauuuugga

SEQ ID NO: 137551 - RNA, 22 nt, Human
cuccugccucagcgauuacagg

SEQ ID NO: 137552 - RNA, 20 nt, Human
gucuguguccaauuaugcac

SEQ ID NO: 137553 - RNA, 26 nt, Human
ugagccagaagcggacagggcaagac

SEQ ID NO: 137554 - RNA, 26 nt, Human
uuuaauuacaguguuuuacugccugg

SEQ ID NO: 137555 - RNA, 20 nt, Human
cuggucccugcccccugccc

SEQ ID NO: 137556 - RNA, 21 nt, Human
ggcuauagcacacaguuauuu

SEQ ID NO: 137557 - RNA, 23 nt, Human
aggggaggggaaacgggaauagu

SEQ ID NO: 137558 - RNA, 24 nt, Human
auaaauacaaagcccauucuucca

SEQ ID NO: 137559 - RNA, 23 nt, Human
ggguuaauagccagauaguagaa

SEQ ID NO: 137560 - RNA, 21 nt, Human
ccaagcugcaaugcaguauug

SEQ ID NO: 137561 - RNA, 25 nt, Human
ucuccagaggaaaauaagaaauaaa

SEQ ID NO: 137562 - RNA, 25 nt, Human
ccaccaggagucuggagugcaaugg

SEQ ID NO: 137563 - RNA, 29 nt, Human
ucagaauucugaguacucugugaagaaca

SEQ ID NO: 137564 - RNA, 21 nt, Human
uuagaagcagaaguaaaauga

SEQ ID NO: 137565 - RNA, 27 nt, Human
cuuccacagccucucguuucuccucca

SEQ ID NO: 137566 - RNA, 27 nt, Human
uagccuugguaucauuuucuagcaaua

SEQ ID NO: 137567 - RNA, 21 nt, Human
caccacuucgcuuuaaagacu

SEQ ID NO: 137568 - RNA, 21 nt, Human
caugagccaccucgcccagcc

SEQ ID NO: 137569 - RNA, 25 nt, Human
gcuccuccuacuguuuaucacuugc

SEQ ID NO: 137570 - RNA, 20 nt, Human
guucuuuuuagaaaauaaca

SEQ ID NO: 137571 - RNA, 25 nt, Human
gcucacugauuguuaacuguagcuu

SEQ ID NO: 137572 - RNA, 22 nt, Human
ugaacaacaaguucgacgcuuu

SEQ ID NO: 137573 - RNA, 23 nt, Human
gugugcaugugacugugcugggu

SEQ ID NO: 137574 - RNA, 17 nt, Human
ucccuucucccaccuua

SEQ ID NO: 137575 - RNA, 19 nt, Human
guuaucucccuccuggccu

SEQ ID NO: 137576 - RNA, 22 nt, Human
caaggcgaccaacacuaggcaa

SEQ ID NO: 137577 - RNA, 21 nt, Human
gguuuccuauguuuucuuucc

SEQ ID NO: 137578 - RNA, 25 nt, Human
ggaggugaagaagagaaugugacag

SEQ ID NO: 137579 - RNA, 31 nt, Human
auaggccaaggaaaucugcauguauuuuugg

SEQ ID NO: 137580 - RNA, 25 nt, Human
ccuccugcugucucugcugguggcc

SEQ ID NO: 137581 - RNA, 26 nt, Human
cugucgaauucaccaucccagccugc

SEQ ID NO: 137582 - RNA, 20 nt, Human
gcaccaccacacccggcuaa

SEQ ID NO: 137583 - RNA, 25 nt, Human
uugcccaaggcccagaucagcugcc

SEQ ID NO: 137584 - RNA, 23 nt, Human
uccuaaguuuauggcacagggua

SEQ ID NO: 137585 - RNA, 27 nt, Human
ccccugccccucugcccagaugcuuca

SEQ ID NO: 137586 - RNA, 24 nt, Human
cuccgccucugcuggcacauuucc

SEQ ID NO: 137587 - RNA, 22 nt, Human
cuccgccggcccccugccucgc

SEQ ID NO: 137588 - RNA, 22 nt, Human
aggcuggagugcagucgugcca

SEQ ID NO: 137589 - RNA, 24 nt, Human
caccuguggucccagcugccucag

SEQ ID NO: 137590 - RNA, 19 nt, Human
cgccucccagggccugugc

SEQ ID NO: 137591 - RNA, 21 nt, Human
cuucccuucccucaucagcau

SEQ ID NO: 137592 - RNA, 25 nt, Human
gagucugaggccccaggcccuagga

SEQ ID NO: 137593 - RNA, 23 nt, Human
gccggcauggucaguuccuggcg

SEQ ID NO: 137594 - RNA, 18 nt, Human
acuuuuaacaguuacagc

SEQ ID NO: 137595 - RNA, 25 nt, Human
ugucuacuuucuucuccauccugcu

SEQ ID NO: 137596 - RNA, 26 nt, Human
ucaaugaugaguccucucuggucaga

SEQ ID NO: 137597 - RNA, 22 nt, Human
ugccuguaaucccaacacuuug

SEQ ID NO: 137598 - RNA, 21 nt, Human
cuggugguucuuacauccccc

SEQ ID NO: 137599 - RNA, 20 nt, Human
gaucccaaaagcauuuaagg

SEQ ID NO: 137600 - RNA, 23 nt, Human
cacugccuuugcuccucccaugu

SEQ ID NO: 137601 - RNA, 23 nt, Human
caggaccucuguaggcagcagag

SEQ ID NO: 137602 - RNA, 22 nt, Human
guauuuuuauuaguauuuuucc

SEQ ID NO: 137603 - RNA, 23 nt, Human
ucaaauuuucccucuucugugau

SEQ ID NO: 137604 - RNA, 21 nt, Human
ggcucuaccugcugugcuuau

SEQ ID NO: 137605 - RNA, 26 nt, Human
uuuagucagaugcagaaaauugccua

SEQ ID NO: 137606 - RNA, 18 nt, Human
cagacaccuccucaccca

SEQ ID NO: 137607 - RNA, 25 nt, Human
accagcuucagaugcucgaggugag

SEQ ID NO: 137608 - RNA, 21 nt, Human
agaaaaccacagagacaggug

SEQ ID NO: 137609 - RNA, 23 nt, Human
cgcagccgccucucccgcuccgg

SEQ ID NO: 137610 - RNA, 26 nt, Human
aaaacaaucagaugagaacaacagau

SEQ ID NO: 137611 - RNA, 27 nt, Human
ccuccuugcagucuccuggaaccagca

SEQ ID NO: 137612 - RNA, 26 nt, Human
augugcaugcgcgugugugcacaggg

SEQ ID NO: 137613 - RNA, 19 nt, Human
gcauucacucucccugucu

SEQ ID NO: 137614 - RNA, 23 nt, Human
gcauuuucacgcugugcuaagca

SEQ ID NO: 137615 - RNA, 23 nt, Human
cucaagcuucccaaguagcugca

SEQ ID NO: 137616 - RNA, 22 nt, Human
cagaugugccuugagaauagua

SEQ ID NO: 137617 - RNA, 26 nt, Human
ccugcucacccgccucuugccccuuc

SEQ ID NO: 137618 - RNA, 22 nt, Human
uguuaucucccuccuggccuuu

SEQ ID NO: 137619 - RNA, 22 nt, Human
gcuuugagagagaaaggacucc

SEQ ID NO: 137620 - RNA, 25 nt, Human
caccacugcauuccagccuggcgac

SEQ ID NO: 137621 - RNA, 26 nt, Human
acccagcauacaaacaagagcugagc

SEQ ID NO: 137622 - RNA, 29 nt, Human
cccagacagacuucaucauugugcuagcu

SEQ ID NO: 137623 - RNA, 24 nt, Human
agacggaggaaggucugaggagca

SEQ ID NO: 137624 - RNA, 24 nt, Human
gaucuggacagaacauuuauauca

SEQ ID NO: 137625 - RNA, 20 nt, Human
agccuccucucccucuguga

SEQ ID NO: 137626 - RNA, 21 nt, Human
ugaggaagacaagcauuuuua

SEQ ID NO: 137627 - RNA, 22 nt, Human
cggagccucagugagcccaucu

SEQ ID NO: 137628 - RNA, 21 nt, Human
acggacugcacguuuguuaca

SEQ ID NO: 137629 - RNA, 23 nt, Human
acaaugguuuuuaaauuuuguaa

SEQ ID NO: 137630 - RNA, 19 nt, Human
uagccuuuuuauagucagu

SEQ ID NO: 137631 - RNA, 21 nt, Human
caaagugauggcuuggaacac

SEQ ID NO: 137632 - RNA, 22 nt, Human
aacaggguguaguucuuuucca

SEQ ID NO: 137633 - RNA, 22 nt, Human
uuaagaucaggaaauguagaca

SEQ ID NO: 137634 - RNA, 25 nt, Human
gcuguagcugggcccugacacuguc

SEQ ID NO: 137635 - RNA, 21 nt, Human
uguuuuuacuaauaauucuug

SEQ ID NO: 137636 - RNA, 22 nt, Human
ugcagccacugccuccuggguu

SEQ ID NO: 137637 - RNA, 23 nt, Human
cugaccuaucacuuccacugcac

SEQ ID NO: 137638 - RNA, 24 nt, Human
ucucagccacuuucagccuuaugc

SEQ ID NO: 137639 - RNA, 19 nt, Human
cuaguccccuaaagguauu

SEQ ID NO: 137640 - RNA, 26 nt, Human
caaccagcaaaauccugauaacaaga

SEQ ID NO: 137641 - RNA, 25 nt, Human
gcacaguuuguguuguggauuugcu

SEQ ID NO: 137642 - RNA, 18 nt, Human
ccacaagacagacuugca

SEQ ID NO: 137643 - RNA, 25 nt, Human
cugcccuuucccugccugaguugcu

SEQ ID NO: 137644 - RNA, 25 nt, Human
cgaggucaccuggaccacucuuggg

SEQ ID NO: 137645 - RNA, 23 nt, Human
cguauauccuggaauaacauguc

SEQ ID NO: 137646 - RNA, 22 nt, Human
uuagcagcaaccgaauauacca

SEQ ID NO: 137647 - RNA, 22 nt, Human
cuugcugcugccuccugggcuc

SEQ ID NO: 137648 - RNA, 22 nt, Human
cguccucugugggggcugccgg

SEQ ID NO: 137649 - RNA, 22 nt, Human
uuauugugacaaaauguugaua

SEQ ID NO: 137650 - RNA, 28 nt, Human
uccucuacacauccccagggcuaucugg

SEQ ID NO: 137651 - RNA, 27 nt, Human
uuugggcaucuggaauugacacaccau

SEQ ID NO: 137652 - RNA, 22 nt, Human
cuuggaggcggagguugcauug

SEQ ID NO: 137653 - RNA, 22 nt, Human
cccuuucucccucugccugacc

SEQ ID NO: 137654 - RNA, 20 nt, Human
cacuccucggccuugcccga

SEQ ID NO: 137655 - RNA, 24 nt, Human
gaguucggucugacaguccuuggg

SEQ ID NO: 137656 - RNA, 22 nt, Human
gaaguuuuguguccauucuuac

SEQ ID NO: 137657 - RNA, 30 nt, Human
ccuuugggaacuuugcuccaacuggugugu

SEQ ID NO: 137658 - RNA, 22 nt, Human
uggucauagaggaagagcuaga

SEQ ID NO: 137659 - RNA, 20 nt, Human
uauggcacccaugcaccuua

SEQ ID NO: 137660 - RNA, 20 nt, Human
aaugugacuguaaaggggcc

SEQ ID NO: 137661 - RNA, 21 nt, Human
gcaucuucagcacuuaccgau

SEQ ID NO: 137662 - RNA, 22 nt, Human
aaagugcugggauuacaggcaa

SEQ ID NO: 137663 - RNA, 22 nt, Human
gccugagccaccgcgcccaguc

SEQ ID NO: 137664 - RNA, 22 nt, Human
gguaauccuugauggcuggauc

SEQ ID NO: 137665 - RNA, 21 nt, Human
uggaaugcagcugucaggccu

SEQ ID NO: 137666 - RNA, 22 nt, Human
uguuuaauaaauaucugagcau

SEQ ID NO: 137667 - RNA, 24 nt, Human
uucucucuucuucauucauauuca

SEQ ID NO: 137668 - RNA, 27 nt, Human
gcgggcgucgcagcugagggaguaagg

SEQ ID NO: 137669 - RNA, 25 nt, Human
agcauuugaauacuccuguuaguag

SEQ ID NO: 137670 - RNA, 23 nt, Human
ugcuucuuacacagcgccauagu

SEQ ID NO: 137671 - RNA, 22 nt, Human
uacuaccuggaaaaagcauugg

SEQ ID NO: 137672 - RNA, 21 nt, Human
ccucugccucuguuuaauaag

SEQ ID NO: 137673 - RNA, 18 nt, Human
ugaaaauauuuuguuaaa

SEQ ID NO: 137674 - RNA, 22 nt, Human
ggugucgaacuccugaccucag

SEQ ID NO: 137675 - RNA, 21 nt, Human
agucauucaggugaccuccug

SEQ ID NO: 137676 - RNA, 27 nt, Human
cuugcccaggcaaggaaagacagcagu

SEQ ID NO: 137677 - RNA, 25 nt, Human
ugccucuccucuuuaucacuuuuaa

SEQ ID NO: 137678 - RNA, 23 nt, Human
auucccaugggcaccaccugccu

SEQ ID NO: 137679 - RNA, 26 nt, Human
uggcuguaaguugccauuugaacuaa

SEQ ID NO: 137680 - RNA, 19 nt, Human
cauccagaugugugcaaug

SEQ ID NO: 137681 - RNA, 26 nt, Human
cugcucccaucauuccuucuggccuc

SEQ ID NO: 137682 - RNA, 25 nt, Human
acuccccgucccauauccugccuca

SEQ ID NO: 137683 - RNA, 23 nt, Human
uguuugcaggcuguaugcuuggu

SEQ ID NO: 137684 - RNA, 20 nt, Human
uaaggcaucagguuguuaga

SEQ ID NO: 137685 - RNA, 27 nt, Human
aaagcgccuagggcuggagaauagcgc

SEQ ID NO: 137686 - RNA, 20 nt, Human
gggaaaggagaaguuaagca

SEQ ID NO: 137687 - RNA, 27 nt, Human
gaccuuugaguuagcugauuucuuuau

SEQ ID NO: 137688 - RNA, 22 nt, Human
ugcagugagccaauaucgugcc

SEQ ID NO: 137689 - RNA, 22 nt, Human
ugcagugagcugauaucgcacc

SEQ ID NO: 137690 - RNA, 18 nt, Human
gcaggcgguggggagaga

SEQ ID NO: 137691 - RNA, 22 nt, Human
gcaguggagcagaaggcaggac

SEQ ID NO: 137692 - RNA, 24 nt, Human
aacuucuaauggccaucuguaaac

SEQ ID NO: 137693 - RNA, 24 nt, Human
cugugaaguucugugcauaugucc

SEQ ID NO: 137694 - RNA, 24 nt, Human
gcuuccccaggaugcgccggcagc

SEQ ID NO: 137695 - RNA, 23 nt, Human
aauucagagcagauuagagccug

SEQ ID NO: 137696 - RNA, 26 nt, Human
uguuuguucccacaugugucucccaa

SEQ ID NO: 137697 - RNA, 22 nt, Human
caacauaguaagacccugucuc

SEQ ID NO: 137698 - RNA, 24 nt, Human
gcaaaggaugcaucuucccacagc

SEQ ID NO: 137699 - RNA, 21 nt, Human
gcuggucucgaacuccugggc

SEQ ID NO: 137700 - RNA, 21 nt, Human
ccuugacagaguggcccaggg

SEQ ID NO: 137701 - RNA, 22 nt, Human
acagggcagagcaggaaggaca

SEQ ID NO: 137702 - RNA, 22 nt, Human
ggcauuugggguuuuguuuuuc

SEQ ID NO: 137703 - RNA, 26 nt, Human
gagggcggcggcgggacagggugagc

SEQ ID NO: 137704 - RNA, 21 nt, Human
aagcaaaauuucuuuucucca

SEQ ID NO: 137705 - RNA, 22 nt, Human
agugagugacuugaccucucua

SEQ ID NO: 137706 - RNA, 22 nt, Human
gucaucaagaugucauggcacc

SEQ ID NO: 137707 - RNA, 24 nt, Human
cugcuacugcuauuccauggaucc

SEQ ID NO: 137708 - RNA, 31 nt, Human
cugcucuuuuuagcuggcuuuuuauuaggcu

SEQ ID NO: 137709 - RNA, 20 nt, Human
caucucaaacucuucucuua

SEQ ID NO: 137710 - RNA, 21 nt, Human
uuugccucacaauuaugcugu

SEQ ID NO: 137711 - RNA, 27 nt, Human
cagaggaagagggagcgggagcucugc

SEQ ID NO: 137712 - RNA, 22 nt, Human
cuacugcacuccagccuggggg

SEQ ID NO: 137713 - RNA, 19 nt, Human
ggagagggguggaggcugc

SEQ ID NO: 137714 - RNA, 23 nt, Human
gucauuuuucuaaacagaggccc

SEQ ID NO: 137715 - RNA, 27 nt, Human
agggcaucuacagccccggccggcgcc

SEQ ID NO: 137716 - RNA, 29 nt, Human
cuuccugugucaugaccucaggaaauaaa

SEQ ID NO: 137717 - RNA, 22 nt, Human
cucucucuucgugccuggucug

SEQ ID NO: 137718 - RNA, 19 nt, Human
aggggaggaaacaggcuuu

SEQ ID NO: 137719 - RNA, 27 nt, Human
aaauagcugggacuacaggcacaggcc

SEQ ID NO: 137720 - RNA, 23 nt, Human
caugcgcacucucauaugccacc

SEQ ID NO: 137721 - RNA, 25 nt, Human
uuccaccucagacaguugcgcuggc

SEQ ID NO: 137722 - RNA, 22 nt, Human
ucuguccgcccaggcugggugc

SEQ ID NO: 137723 - RNA, 21 nt, Human
uugguuagagugcagcaagca

SEQ ID NO: 137724 - RNA, 27 nt, Human
uguuuuuaaaguaaaugucuuuuagug

SEQ ID NO: 137725 - RNA, 23 nt, Human
ucuuccagcugcaaacagcuaaa

SEQ ID NO: 137726 - RNA, 27 nt, Human
ccagcugccaccccccaccuuacccuu

SEQ ID NO: 137727 - RNA, 27 nt, Human
gguuguggcugaugguguugaagauaa

SEQ ID NO: 137728 - RNA, 27 nt, Human
aucaccuaggcuggagugcagcggcau

SEQ ID NO: 137729 - RNA, 22 nt, Human
gaaaaugcagaggcucgggcuu

SEQ ID NO: 137730 - RNA, 27 nt, Human
aacucagaaaacuaaggcuuuggcccu

SEQ ID NO: 137731 - RNA, 28 nt, Human
gguggaggagaugcagggccaccugaag

SEQ ID NO: 137732 - RNA, 27 nt, Human
cacucaccccccacaccuuccccggcc

SEQ ID NO: 137733 - RNA, 18 nt, Human
gucucauucugucaccca

SEQ ID NO: 137734 - RNA, 27 nt, Human
uguccccaaguaugaggugaacggggu

SEQ ID NO: 137735 - RNA, 22 nt, Human
uaggcuggaggacaguggcaca

SEQ ID NO: 137736 - RNA, 21 nt, Human
ggagcaguuggcuucugguuu

SEQ ID NO: 137737 - RNA, 22 nt, Human
agggugagacaguccacccaga

SEQ ID NO: 137738 - RNA, 20 nt, Human
gcggggcugugugccggccu

SEQ ID NO: 137739 - RNA, 22 nt, Human
caccgaggcuggagugcaauga

SEQ ID NO: 137740 - RNA, 24 nt, Human
guccuuguuguuucuugccugaac

SEQ ID NO: 137741 - RNA, 22 nt, Human
uccucacaccagcuacuugcaa

SEQ ID NO: 137742 - RNA, 23 nt, Human
uguggaauuuuugcagaaguguu

SEQ ID NO: 137743 - RNA, 25 nt, Human
ugggaggugggaguggcugcaggga

SEQ ID NO: 137744 - RNA, 27 nt, Human
ggucuugaucuccugaccucgugaucc

SEQ ID NO: 137745 - RNA, 22 nt, Human
cugacccacagaaccauaagau

SEQ ID NO: 137746 - RNA, 25 nt, Human
ggcaccagaacccugucuuccucca

SEQ ID NO: 137747 - RNA, 22 nt, Human
cuguauacagagguucaucuca

SEQ ID NO: 137748 - RNA, 19 nt, Human
gcugucuggcccuugcugg

SEQ ID NO: 137749 - RNA, 27 nt, Human
cccucuguugccaggcuagagugcagu

SEQ ID NO: 137750 - RNA, 18 nt, Human
cucuccucugcugcagcu

SEQ ID NO: 137751 - RNA, 21 nt, Human
gccacuucuagcacaaccaga

SEQ ID NO: 137752 - RNA, 24 nt, Human
ggugaacuggaguuucucuuguga

SEQ ID NO: 137753 - RNA, 19 nt, Human
caccucuguggccaccuca

SEQ ID NO: 137754 - RNA, 27 nt, Human
gcccguccugguaucacagugcuucug

SEQ ID NO: 137755 - RNA, 21 nt, Human
cggccccugaaguggagcgag

SEQ ID NO: 137756 - RNA, 24 nt, Human
uuuucauaagugguauguuuaauu

SEQ ID NO: 137757 - RNA, 22 nt, Human
guugcccagcuuuccuggcaau

SEQ ID NO: 137758 - RNA, 22 nt, Human
gaguagcugggauuacaggugu

SEQ ID NO: 137759 - RNA, 23 nt, Human
ggaggauaacuuucacaggguaa

SEQ ID NO: 137760 - RNA, 18 nt, Human
acucccauucacccacca

SEQ ID NO: 137761 - RNA, 31 nt, Human
cgccucucccugcacucccuccuggagcucu

SEQ ID NO: 137762 - RNA, 23 nt, Human
auguccaaggagcaacuaaugag

SEQ ID NO: 137763 - RNA, 23 nt, Human
uccaggaccuugcuuccuucuca

SEQ ID NO: 137764 - RNA, 27 nt, Human
caggcagcagcaaagccaguucccuuc

SEQ ID NO: 137765 - RNA, 24 nt, Human
acuccuuuauuauacauacacaug

SEQ ID NO: 137766 - RNA, 19 nt, Human
aguacucaggcagugcagu

SEQ ID NO: 137767 - RNA, 22 nt, Human
aagcuagcagaaacuccauuuu

SEQ ID NO: 137768 - RNA, 26 nt, Human
acuguucugccagccuaacaaagcaa

SEQ ID NO: 137769 - RNA, 24 nt, Human
aagcagcugcacucagacaaugcc

SEQ ID NO: 137770 - RNA, 22 nt, Human
cauugcccugagcugcuaggau

SEQ ID NO: 137771 - RNA, 21 nt, Human
acauggggcacugggacuuca

SEQ ID NO: 137772 - RNA, 18 nt, Human
ccagccgccagaccucag

SEQ ID NO: 137773 - RNA, 20 nt, Human
gguccccagcauugcaguau

SEQ ID NO: 137774 - RNA, 24 nt, Human
auuuaucagcuauuuuagcauuaa

SEQ ID NO: 137775 - RNA, 23 nt, Human
gcggccucuccccuguugcugcc

SEQ ID NO: 137776 - RNA, 16 nt, Human
cuucccuucgcucccu

SEQ ID NO: 137777 - RNA, 22 nt, Human
cucuugucaucaacagccguga

SEQ ID NO: 137778 - RNA, 26 nt, Human
ccacugcgcccagccugaaucauuuc

SEQ ID NO: 137779 - RNA, 24 nt, Human
gggcagugcauccagaagcguuua

SEQ ID NO: 137780 - RNA, 22 nt, Human
gucucgaacuccugacaucagg

SEQ ID NO: 137781 - RNA, 24 nt, Human
gauuuugcuuuucucuuuuauuau

SEQ ID NO: 137782 - RNA, 20 nt, Human
aacuccagggccccaaagag

SEQ ID NO: 137783 - RNA, 29 nt, Human
aaucuauugacugaauuaucuuuugcaga

SEQ ID NO: 137784 - RNA, 22 nt, Human
caagggcagggggccccuuugc

SEQ ID NO: 137785 - RNA, 22 nt, Human
accagcggaaacaggugugugu

SEQ ID NO: 137786 - RNA, 26 nt, Human
acagaagucuuaagucuguggcacac

SEQ ID NO: 137787 - RNA, 22 nt, Human
cguggccaccugagaccugcuc

SEQ ID NO: 137788 - RNA, 18 nt, Human
ugccccguccccaccucg

SEQ ID NO: 137789 - RNA, 23 nt, Human
ugucgcucagccuggagugcagu

SEQ ID NO: 137790 - RNA, 18 nt, Human
gaguugcuaaugacuguc

SEQ ID NO: 137791 - RNA, 21 nt, Human
gcaucaggaaggccuuugcuu

SEQ ID NO: 137792 - RNA, 24 nt, Human
cagugguucucaucaagggucaau

SEQ ID NO: 137793 - RNA, 22 nt, Human
aaagagagcuuaaugauaauau

SEQ ID NO: 137794 - RNA, 22 nt, Human
uaaaugccacugacaauguuau

SEQ ID NO: 137795 - RNA, 24 nt, Human
aggcuccaccuuaacugugcucag

SEQ ID NO: 137796 - RNA, 15 nt, Human
gaacuccagaccuga

SEQ ID NO: 137797 - RNA, 26 nt, Human
gcagugaggggcccuccaugcgcaga

SEQ ID NO: 137798 - RNA, 22 nt, Human
cuuucucuuacaaucuguuuua

SEQ ID NO: 137799 - RNA, 25 nt, Human
cuuuacagcucuccuccagcccugg

SEQ ID NO: 137800 - RNA, 24 nt, Human
aagacuguucuucagaaucauguu

SEQ ID NO: 137801 - RNA, 23 nt, Human
cuccaacaacagaaguggcaucu

SEQ ID NO: 137802 - RNA, 20 nt, Human
ugagggaagagggagacugg

SEQ ID NO: 137803 - RNA, 22 nt, Human
uggccagcauggcgaaacccca

SEQ ID NO: 137804 - RNA, 22 nt, Human
cacgaggucaggauauugagac

SEQ ID NO: 137805 - RNA, 26 nt, Human
gugcugccccauccaccuacagcccu

SEQ ID NO: 137806 - RNA, 20 nt, Human
uuguccccuuccucuaauua

SEQ ID NO: 137807 - RNA, 23 nt, Human
cccaccccccaccacugcccccu

SEQ ID NO: 137808 - RNA, 26 nt, Human
acauggacacaccccaaacacgcaca

SEQ ID NO: 137809 - RNA, 22 nt, Human
ccugccuguacauacacaugca

SEQ ID NO: 137810 - RNA, 24 nt, Human
guuacuuuagguuuguucccuuga

SEQ ID NO: 137811 - RNA, 24 nt, Human
guggaaauuuggagaaguugcggc

SEQ ID NO: 137812 - RNA, 23 nt, Human
aagaaaaucaucuuggccacuuu

SEQ ID NO: 137813 - RNA, 22 nt, Human
ggccucggagcaccagucacuu

SEQ ID NO: 137814 - RNA, 13 nt, Human
cuguggguugcua

SEQ ID NO: 137815 - RNA, 25 nt, Human
auuccucucuggaggccuugcuuuc

SEQ ID NO: 137816 - RNA, 24 nt, Human
ggcacgguuuccagauguaauacu

SEQ ID NO: 137817 - RNA, 21 nt, Human
uuugggaaaaacguuugcaga

SEQ ID NO: 137818 - RNA, 21 nt, Human
cugggccccuucucuccuggg

SEQ ID NO: 137819 - RNA, 21 nt, Human
ccccuucuccuccuuucuccc

SEQ ID NO: 137820 - RNA, 21 nt, Human
ugaaauccaggaauuaaauca

SEQ ID NO: 137821 - RNA, 26 nt, Human
cgcgcuucucugggccagagcgagcc

SEQ ID NO: 137822 - RNA, 20 nt, Human
ucugcugcacucugcuuggg

SEQ ID NO: 137823 - RNA, 24 nt, Human
caugaucuuccccaucaggcuggg

SEQ ID NO: 137824 - RNA, 24 nt, Human
ucagggugauuucaccuggaacag

SEQ ID NO: 137825 - RNA, 16 nt, Human
gggcuguaucucuccc

SEQ ID NO: 137826 - RNA, 18 nt, Human
cacugucuuguucuugaa

SEQ ID NO: 137827 - RNA, 21 nt, Human
cugccuggcauguggcacuuu

SEQ ID NO: 137828 - RNA, 22 nt, Human
ucuccaccuuccaaagagugcu

SEQ ID NO: 137829 - RNA, 27 nt, Human
ucugggaggggccagagucagacaacu

SEQ ID NO: 137830 - RNA, 20 nt, Human
ucuucagcaaaaauauuuua

SEQ ID NO: 137831 - RNA, 26 nt, Human
gcugccucucuccugggaccgugggg

SEQ ID NO: 137832 - RNA, 21 nt, Human
uccaugaaauaaacaaugacu

SEQ ID NO: 137833 - RNA, 20 nt, Human
ggucuccagggcacaggauc

SEQ ID NO: 137834 - RNA, 28 nt, Human
uacccugcccuggcuggcaugugagaag

SEQ ID NO: 137835 - RNA, 20 nt, Human
uuucugucuccuccucccgc

SEQ ID NO: 137836 - RNA, 24 nt, Human
ucuggccugcugcccugcaccccc

SEQ ID NO: 137837 - RNA, 21 nt, Human
auggggcagaacgaacuuuaa

SEQ ID NO: 137838 - RNA, 26 nt, Human
uuguugcuuuguaacuuuuugcacua

SEQ ID NO: 137839 - RNA, 26 nt, Human
gcacagggcaucaacauggccaacag

SEQ ID NO: 137840 - RNA, 26 nt, Human
ggggacaccucaggagcuuuacucau

SEQ ID NO: 137841 - RNA, 23 nt, Human
agucgcccaggcuggagugcagc

SEQ ID NO: 137842 - RNA, 22 nt, Human
guaaggaggggagccuccaagu

SEQ ID NO: 137843 - RNA, 21 nt, Human
aggagaaaauucuccagguga

SEQ ID NO: 137844 - RNA, 23 nt, Human
cugcccugccugccugcccuggg

SEQ ID NO: 137845 - RNA, 26 nt, Human
caaaccugcauauugugauuuuaauu

SEQ ID NO: 137846 - RNA, 22 nt, Human
ccuaguaguugggauuacaggc

SEQ ID NO: 137847 - RNA, 24 nt, Human
uucuuccuacaaugcugugugaua

SEQ ID NO: 137848 - RNA, 22 nt, Human
uauguguguaucauacacauca

SEQ ID NO: 137849 - RNA, 26 nt, Human
cucucucuccccugcacuagcugucc

SEQ ID NO: 137850 - RNA, 28 nt, Human
gcgcgccacucgcuucccccauagccac

SEQ ID NO: 137851 - RNA, 26 nt, Human
uauuacacaggacagccaggggagga

SEQ ID NO: 137852 - RNA, 21 nt, Human
uaucuugccaccuuagccuua

SEQ ID NO: 137853 - RNA, 21 nt, Human
uuccuuaacccgcugccucag

SEQ ID NO: 137854 - RNA, 21 nt, Human
aggaaacaaaauguucugcua

SEQ ID NO: 137855 - RNA, 20 nt, Human
ccaggugaagaaauuuagcu

SEQ ID NO: 137856 - RNA, 22 nt, Human
ugggaaagaucagagaggcaga

SEQ ID NO: 137857 - RNA, 24 nt, Human
gacgcgcccugggcgcacgcccag

SEQ ID NO: 137858 - RNA, 28 nt, Human
ugcugagugucccugaaaccauggcagc

SEQ ID NO: 137859 - RNA, 25 nt, Human
uauucuaccacuugcacuuacucau

SEQ ID NO: 137860 - RNA, 20 nt, Human
aaauauccgcuacacagguu

SEQ ID NO: 137861 - RNA, 24 nt, Human
ccucugcagcugaccucuguuguc

SEQ ID NO: 137862 - RNA, 21 nt, Human
aggcagcagguaggacaguga

SEQ ID NO: 137863 - RNA, 23 nt, Human
aucuuugaaggaguccucaggcc

SEQ ID NO: 137864 - RNA, 25 nt, Human
gcgcacacuguauguacauacuggc

SEQ ID NO: 137865 - RNA, 23 nt, Human
gcccuacaaaaagggcgcaucuu

SEQ ID NO: 137866 - RNA, 20 nt, Human
gacgagaagacucagccuga

SEQ ID NO: 137867 - RNA, 14 nt, Human
cuucccuuuagaca

SEQ ID NO: 137868 - RNA, 26 nt, Human
gcacaaccuuguccacagccauuuua

SEQ ID NO: 137869 - RNA, 31 nt, Human
ccccauccgggaaagaugguggaagacauag

SEQ ID NO: 137870 - RNA, 18 nt, Human
cgggugagcugagcuugg

SEQ ID NO: 137871 - RNA, 29 nt, Human
ucagaaaaggagagguugacagucaucca

SEQ ID NO: 137872 - RNA, 22 nt, Human
cccugccaaccuggccugggug

SEQ ID NO: 137873 - RNA, 21 nt, Human
gccuguaaucccaacacuuug

SEQ ID NO: 137874 - RNA, 21 nt, Human
aacaaauuuguccccacgggc

SEQ ID NO: 137875 - RNA, 29 nt, Human
cccauugcucuccuccaggggcagaacau

SEQ ID NO: 137876 - RNA, 22 nt, Human
cccuucuaguccaaccccccuc

SEQ ID NO: 137877 - RNA, 20 nt, Human
gcccucucgccuccuccucc

SEQ ID NO: 137878 - RNA, 24 nt, Human
gccuguaaucucggaaggcugagg

SEQ ID NO: 137879 - RNA, 26 nt, Human
gggucucaggacagugauguuggcua

SEQ ID NO: 137880 - RNA, 27 nt, Human
ggagaggggaaggaucagggggccagg

SEQ ID NO: 137881 - RNA, 26 nt, Human
acuuuuugaauucuauguuggcauua

SEQ ID NO: 137882 - RNA, 27 nt, Human
cuucugcugcccugaugcgucuaccca

SEQ ID NO: 137883 - RNA, 19 nt, Human
uccuucaaaacaaucugca

SEQ ID NO: 137884 - RNA, 22 nt, Human
uucauucucucucagcugugca

SEQ ID NO: 137885 - RNA, 20 nt, Human
ucuccacccuaacucagacc

SEQ ID NO: 137886 - RNA, 20 nt, Human
aggaagguuuugcagaggag

SEQ ID NO: 137887 - RNA, 26 nt, Human
ggagcacgucccgccggcagucgcag

SEQ ID NO: 137888 - RNA, 21 nt, Human
uaucagauaaggcaaacuacc

SEQ ID NO: 137889 - RNA, 25 nt, Human
ggcccgggaggggagugacagaggg

SEQ ID NO: 137890 - RNA, 22 nt, Human
uuacuauuccaguaaggcagag

SEQ ID NO: 137891 - RNA, 20 nt, Human
cgcccgcauccagauuuuug

SEQ ID NO: 137892 - RNA, 21 nt, Human
ucgggaguuggaggccagccu

SEQ ID NO: 137893 - RNA, 26 nt, Human
ucgcugagacuuccuggaccccgcac

SEQ ID NO: 137894 - RNA, 23 nt, Human
gccaaauuggaauccuggacuua

SEQ ID NO: 137895 - RNA, 22 nt, Human
gcccuggguucuuccacagcac

SEQ ID NO: 137896 - RNA, 22 nt, Human
agguauuucccgucuaacagaa

SEQ ID NO: 137897 - RNA, 20 nt, Human
cuaagaauugaaauguauca

SEQ ID NO: 137898 - RNA, 21 nt, Human
uacaaccauugucucacugga

SEQ ID NO: 137899 - RNA, 22 nt, Human
uugguucuucccaagaaacacu

SEQ ID NO: 137900 - RNA, 19 nt, Human
agccccacugcagucauca

SEQ ID NO: 137901 - RNA, 20 nt, Human
uuuuacgucuccuucacuga

SEQ ID NO: 137902 - RNA, 20 nt, Human
gagcagggacucagcacaga

SEQ ID NO: 137903 - RNA, 21 nt, Human
acaaacuguuuuccacagcag

SEQ ID NO: 137904 - RNA, 20 nt, Human
ggaagcugaauccagcaaga

SEQ ID NO: 137905 - RNA, 22 nt, Human
uggaacauagccacacucauuu

SEQ ID NO: 137906 - RNA, 22 nt, Human
acaagucccauauuuugucagu

SEQ ID NO: 137907 - RNA, 27 nt, Human
cucacaguccugcacaccugcuggccu

SEQ ID NO: 137908 - RNA, 20 nt, Human
gguccagagcaggagcuucu

SEQ ID NO: 137909 - RNA, 24 nt, Human
uugcccaggcuggagugcaauggu

SEQ ID NO: 137910 - RNA, 23 nt, Human
augucuagcccaucauccugcuu

SEQ ID NO: 137911 - RNA, 19 nt, Human
ccuuuggccacuguauuug

SEQ ID NO: 137912 - RNA, 23 nt, Human
aaagauaagacuuccucuaccac

SEQ ID NO: 137913 - RNA, 22 nt, Human
cugucucucuggcaggagugcc

SEQ ID NO: 137914 - RNA, 29 nt, Human
cccugccaggacuccucugggcuugcagu

SEQ ID NO: 137915 - RNA, 19 nt, Human
cauggaggggaggaaaggc

SEQ ID NO: 137916 - RNA, 22 nt, Human
ugucacccagguucgaguucag

SEQ ID NO: 137917 - RNA, 22 nt, Human
ggggaaagaaaaggaagcugca

SEQ ID NO: 137918 - RNA, 16 nt, Human
cgacagugccaucccc

SEQ ID NO: 137919 - RNA, 25 nt, Human
uaccucaggcuguggcgggagcaga

SEQ ID NO: 137920 - RNA, 26 nt, Human
cuuacccaggauggaaacacugcagu

SEQ ID NO: 137921 - RNA, 23 nt, Human
auuucuccaagagcaggcuuggc

SEQ ID NO: 137922 - RNA, 22 nt, Human
agcaaauucuguuuuucuaggc

SEQ ID NO: 137923 - RNA, 22 nt, Human
auugauuucacaauagggguua

SEQ ID NO: 137924 - RNA, 24 nt, Human
gcggaugcagccuaccuccugggc

SEQ ID NO: 137925 - RNA, 19 nt, Human
cagcauccuggaaauuugu

SEQ ID NO: 137926 - RNA, 20 nt, Human
cucccacggccucugaggcu

SEQ ID NO: 137927 - RNA, 24 nt, Human
ugcucuggguuagguuuucugugg

SEQ ID NO: 137928 - RNA, 23 nt, Human
gccuagcccuggcggaggugcag

SEQ ID NO: 137929 - RNA, 21 nt, Human
acguucccaccugccuagcca

SEQ ID NO: 137930 - RNA, 27 nt, Human
ccagguggcagguugcugcucucuccu

SEQ ID NO: 137931 - RNA, 21 nt, Human
cccugucuccccucagcaguc

SEQ ID NO: 137932 - RNA, 22 nt, Human
cacagccaccuucuccuccucc

SEQ ID NO: 137933 - RNA, 24 nt, Human
ugggcacaguggugugcaucugua

SEQ ID NO: 137934 - RNA, 25 nt, Human
ccacagccauagaccuacagaccug

SEQ ID NO: 137935 - RNA, 22 nt, Human
ggagguggcccacagaacgcgg

SEQ ID NO: 137936 - RNA, 23 nt, Human
cagggagucagagguuucaguga

SEQ ID NO: 137937 - RNA, 20 nt, Human
aauggacacugugcccagcc

SEQ ID NO: 137938 - RNA, 27 nt, Human
aucagcuguuaaccauuugcaccucua

SEQ ID NO: 137939 - RNA, 22 nt, Human
ucucaaacuuuuuggucucaga

SEQ ID NO: 137940 - RNA, 23 nt, Human
gggucuguagguuguugcaguga

SEQ ID NO: 137941 - RNA, 24 nt, Human
acaaacccaauaaacucuguagag

SEQ ID NO: 137942 - RNA, 22 nt, Human
gcucacugcaacuucugccucu

SEQ ID NO: 137943 - RNA, 22 nt, Human
cuccaccuuccugguucaagcg

SEQ ID NO: 137944 - RNA, 22 nt, Human
ucgccucccugguucaagcaau

SEQ ID NO: 137945 - RNA, 23 nt, Human
gcugcccaggcugugcagcgcag

SEQ ID NO: 137946 - RNA, 21 nt, Human
gggacugcacuccagccuggg

SEQ ID NO: 137947 - RNA, 20 nt, Human
cgcccuggcuggagugcaau

SEQ ID NO: 137948 - RNA, 26 nt, Human
uuggaaggcaggcaccacggcagguu

SEQ ID NO: 137949 - RNA, 20 nt, Human
acuguucuuuucccucuuag

SEQ ID NO: 137950 - RNA, 21 nt, Human
gggcucacuggaguggcagau

SEQ ID NO: 137951 - RNA, 27 nt, Human
ggaaguuaagaguuuugacuuucgggg

SEQ ID NO: 137952 - RNA, 24 nt, Human
gcauaccuguaccuccaaaaguga

SEQ ID NO: 137953 - RNA, 31 nt, Human
aaagucuccagaagaaaauuugccaaucuuu

SEQ ID NO: 137954 - RNA, 30 nt, Human
gcucagugaucgccuccaacagcaucaucu

SEQ ID NO: 137955 - RNA, 22 nt, Human
cgaacuccuggucucuugcggu

SEQ ID NO: 137956 - RNA, 22 nt, Human
uucugucucauguuuaucugag

SEQ ID NO: 137957 - RNA, 24 nt, Human
uguaucucacacagugccuugcua

SEQ ID NO: 137958 - RNA, 23 nt, Human
cccccaccccgccucauucuuua

SEQ ID NO: 137959 - RNA, 28 nt, Human
ucccgagacguguaaugacaccacacuu

SEQ ID NO: 137960 - RNA, 24 nt, Human
uugauauucucaugggcuuugcug

SEQ ID NO: 137961 - RNA, 24 nt, Human
ucaagccccaaaugguugggggag

SEQ ID NO: 137962 - RNA, 23 nt, Human
aagaacaucauuuaaauacacaa

SEQ ID NO: 137963 - RNA, 25 nt, Human
gccuccacccuccuccucuucacca

SEQ ID NO: 137964 - RNA, 27 nt, Human
ggagcaucucuuccucuucuguugcca

SEQ ID NO: 137965 - RNA, 27 nt, Human
gacugcuuggguccuccacuguccucu

SEQ ID NO: 137966 - RNA, 24 nt, Human
ugcuggcucuuguuucacuggggg

SEQ ID NO: 137967 - RNA, 21 nt, Human
gggagggggcugcugcccacc

SEQ ID NO: 137968 - RNA, 19 nt, Human
agcuuccguguuccuugcc

SEQ ID NO: 137969 - RNA, 20 nt, Human
gaagugaggaggugggccgg

SEQ ID NO: 137970 - RNA, 19 nt, Human
ccugcuucgcgccugcugc

SEQ ID NO: 137971 - RNA, 27 nt, Human
accuaaagcaggaggccaggagcccag

SEQ ID NO: 137972 - RNA, 21 nt, Human
uccaaacuuuagcaacaguua

SEQ ID NO: 137973 - RNA, 22 nt, Human
uauucuacauuauuauaugaca

SEQ ID NO: 137974 - RNA, 21 nt, Human
cauccuggagcacagcucuuc

SEQ ID NO: 137975 - RNA, 21 nt, Human
cggccgcaccuggcuggagag

SEQ ID NO: 137976 - RNA, 25 nt, Human
ccauauuuucacaagacagucauca

SEQ ID NO: 137977 - RNA, 23 nt, Human
cucccuggugcuuaugcucuuaa

SEQ ID NO: 137978 - RNA, 23 nt, Human
cugcaugcugugccugccgcgug

SEQ ID NO: 137979 - RNA, 21 nt, Human
cgcacucgggcgcggagggag

SEQ ID NO: 137980 - RNA, 23 nt, Human
ucuuagcaauaaaugcuuuucua

SEQ ID NO: 137981 - RNA, 21 nt, Human
acucccuugcucugcgcugcu

SEQ ID NO: 137982 - RNA, 21 nt, Human
uccuagcuggagugccauggc

SEQ ID NO: 137983 - RNA, 19 nt, Human
ccuccuggccccgcccugc

SEQ ID NO: 137984 - RNA, 27 nt, Human
ucccuguagggaagacucccagcacuu

SEQ ID NO: 137985 - RNA, 19 nt, Human
cugggcucacugcaggcau

SEQ ID NO: 137986 - RNA, 24 nt, Human
gucgccuagacuggauaguggggg

SEQ ID NO: 137987 - RNA, 22 nt, Human
guuacccaggcuggagugcaau

SEQ ID NO: 137988 - RNA, 22 nt, Human
caccuguaaucccagcgcuuug

SEQ ID NO: 137989 - RNA, 22 nt, Human
caccuguagucccagcacuuug

SEQ ID NO: 137990 - RNA, 22 nt, Human
gcuacaucuucucugguugagg

SEQ ID NO: 137991 - RNA, 31 nt, Human
ggagguuggugccuuccugggaacuagccac

SEQ ID NO: 137992 - RNA, 23 nt, Human
gggaacaguauggaaaagacugg

SEQ ID NO: 137993 - RNA, 21 nt, Human
uucuuguucugugucacucgg

SEQ ID NO: 137994 - RNA, 26 nt, Human
ccaagaauuaaguauuuuccuaagca

SEQ ID NO: 137995 - RNA, 27 nt, Human
uucauucuucuuuaaaguagccucuau

SEQ ID NO: 137996 - RNA, 19 nt, Human
aguggcugauuggaagggg

SEQ ID NO: 137997 - RNA, 21 nt, Human
ggaagcugggguuugcagugg

SEQ ID NO: 137998 - RNA, 22 nt, Human
gcuacccaggcaguggugaucu

SEQ ID NO: 137999 - RNA, 23 nt, Human
cgggguggggagggaggggagga

SEQ ID NO: 138000 - RNA, 20 nt, Human
ucaguucuaauuccaaaaag

SEQ ID NO: 138001 - RNA, 22 nt, Human
ucaaugccucuggcucuacaca

SEQ ID NO: 138002 - RNA, 27 nt, Human
cucagcugaccacccuccucugaccca

SEQ ID NO: 138003 - RNA, 22 nt, Human
guggagccuguuccucacugga

SEQ ID NO: 138004 - RNA, 19 nt, Human
ucauggccauggcaaccaa

SEQ ID NO: 138005 - RNA, 21 nt, Human
uaucuguguuuucaccauuca

SEQ ID NO: 138006 - RNA, 21 nt, Human
uuugccccucacccaccagcu

SEQ ID NO: 138007 - RNA, 24 nt, Human
uggaaggacgaaggugagugaaga

SEQ ID NO: 138008 - RNA, 25 nt, Human
ucugucauccaggcuggagugcagu

SEQ ID NO: 138009 - RNA, 24 nt, Human
ccuccauggcugaugaccucagcu

SEQ ID NO: 138010 - RNA, 22 nt, Human
ggccuggugucuccucaugccc

SEQ ID NO: 138011 - RNA, 27 nt, Human
aaaugugcuaaguuauuugagacuucc

SEQ ID NO: 138012 - RNA, 20 nt, Human
agagacccgggaaggaaggc

SEQ ID NO: 138013 - RNA, 23 nt, Human
cauuguccuaaaaccuuauuuua

SEQ ID NO: 138014 - RNA, 21 nt, Human
ccccgccuccccuuaagcacc

SEQ ID NO: 138015 - RNA, 25 nt, Human
ccugcugcaccuuccccacccccuc

SEQ ID NO: 138016 - RNA, 23 nt, Human
uggugggagcaggaaggagcagu

SEQ ID NO: 138017 - RNA, 22 nt, Human
gucuguuuacacuucucuguag

SEQ ID NO: 138018 - RNA, 22 nt, Human
guccagcgaccuuccucaucca

SEQ ID NO: 138019 - RNA, 23 nt, Human
aucauuuauccaaaggcuuucca

SEQ ID NO: 138020 - RNA, 22 nt, Human
ugucagaugucacauaauuacu

SEQ ID NO: 138021 - RNA, 28 nt, Human
cccaauaaacaugacacacuguguuggc

SEQ ID NO: 138022 - RNA, 15 nt, Human
ucuauaaaugccuuc

SEQ ID NO: 138023 - RNA, 23 nt, Human
caggagugacagaucacagggug

SEQ ID NO: 138024 - RNA, 21 nt, Human
auacuuccugcgccugccuuc

SEQ ID NO: 138025 - RNA, 22 nt, Human
gcucacugcagccuugaccucc

SEQ ID NO: 138026 - RNA, 21 nt, Human
agauccuacucuuccuuucua

SEQ ID NO: 138027 - RNA, 24 nt, Human
cacacuccuuacuugacugcuuuc

SEQ ID NO: 138028 - RNA, 30 nt, Human
gagaucuacagggacauguacugguuccuu

SEQ ID NO: 138029 - RNA, 24 nt, Human
cugucucagggacuucuucgcuga

SEQ ID NO: 138030 - RNA, 28 nt, Human
auggauggagggagagcagaggccuuug

SEQ ID NO: 138031 - RNA, 27 nt, Human
gcaagcuguuucaguuugcaaaaucac

SEQ ID NO: 138032 - RNA, 18 nt, Human
gcucuaaaaaugaaauug

SEQ ID NO: 138033 - RNA, 21 nt, Human
cucagggcuuuucggagccug

SEQ ID NO: 138034 - RNA, 22 nt, Human
ucugucucauccuccuggaacc

SEQ ID NO: 138035 - RNA, 25 nt, Human
ugcuguuuucacauccuuucccuua

SEQ ID NO: 138036 - RNA, 20 nt, Human
ccagucugugcuccugggcu

SEQ ID NO: 138037 - RNA, 17 nt, Human
uaaaaacaaaaggcaau

SEQ ID NO: 138038 - RNA, 26 nt, Human
gcauaggaccuuuccaccacagccag

SEQ ID NO: 138039 - RNA, 21 nt, Human
ggcuuuucaggcuugcccuca

SEQ ID NO: 138040 - RNA, 21 nt, Human
uucaguuuuuaaugauugcca

SEQ ID NO: 138041 - RNA, 22 nt, Human
caugauugcacuccaaccuggg

SEQ ID NO: 138042 - RNA, 23 nt, Human
cuacgcacacaguauuuuuucau

SEQ ID NO: 138043 - RNA, 24 nt, Human
cuacagugcauacagccuuugcca

SEQ ID NO: 138044 - RNA, 22 nt, Human
agggaagugucuucuugcccac

SEQ ID NO: 138045 - RNA, 21 nt, Human
ucuccuuugagcuucugggcc

SEQ ID NO: 138046 - RNA, 22 nt, Human
gucacuuuuuguuaaguucuuu

SEQ ID NO: 138047 - RNA, 27 nt, Human
cgcugcugccgugggccugagaccaag

SEQ ID NO: 138048 - RNA, 23 nt, Human
ccucugcagaggggaccucagcc

SEQ ID NO: 138049 - RNA, 23 nt, Human
gcccaggcugagagcagcagggu

SEQ ID NO: 138050 - RNA, 19 nt, Human
auaccuccccuccacauca

SEQ ID NO: 138051 - RNA, 22 nt, Human
caaguucaagacuuaacucagg

SEQ ID NO: 138052 - RNA, 24 nt, Human
uggggcagagccaacucucgagcg

SEQ ID NO: 138053 - RNA, 26 nt, Human
ugcccaggcuggaguguaguggcgcg

SEQ ID NO: 138054 - RNA, 20 nt, Human
gcguuucucccucccaggcu

SEQ ID NO: 138055 - RNA, 25 nt, Human
gcucuucuccccguguaggggagcc

SEQ ID NO: 138056 - RNA, 22 nt, Human
cugcgucucugggcgcuggagc

SEQ ID NO: 138057 - RNA, 23 nt, Human
gugacugcccucuagcuuuugcu

SEQ ID NO: 138058 - RNA, 23 nt, Human
gaauucugcaaggguucuuggug

SEQ ID NO: 138059 - RNA, 21 nt, Human
uaccaacauggagaaacccca

SEQ ID NO: 138060 - RNA, 22 nt, Human
cccuugccccucccccagaggg

SEQ ID NO: 138061 - RNA, 22 nt, Human
acugcauccuccgccucccggg

SEQ ID NO: 138062 - RNA, 24 nt, Human
gccucaucuucuaggccuuuucca

SEQ ID NO: 138063 - RNA, 27 nt, Human
gggcuguaaaaggcagcguguggaggu

SEQ ID NO: 138064 - RNA, 21 nt, Human
accuuuguuccucaauagcug

SEQ ID NO: 138065 - RNA, 21 nt, Human
cuugaaaacauggaggauuuu

SEQ ID NO: 138066 - RNA, 22 nt, Human
ggcaaaauaaaauaaagguaau

SEQ ID NO: 138067 - RNA, 25 nt, Human
ccagccuggucccauaucauaguga

SEQ ID NO: 138068 - RNA, 22 nt, Human
ugacuucuuacagagcuguaau

SEQ ID NO: 138069 - RNA, 27 nt, Human
caugaaagguugguucuugacucugaa

SEQ ID NO: 138070 - RNA, 27 nt, Human
ccugcagcggcacaaaugcaccuccca

SEQ ID NO: 138071 - RNA, 18 nt, Human
cauagcaaguguucagua

SEQ ID NO: 138072 - RNA, 23 nt, Human
cauuccugccuuccagugcccca

SEQ ID NO: 138073 - RNA, 22 nt, Human
aggccuuucccaucuggagaga

SEQ ID NO: 138074 - RNA, 25 nt, Human
cugucucccaggcuggagugcagug

SEQ ID NO: 138075 - RNA, 27 nt, Human
cccugcauuuaccaaaauuugugcaca

SEQ ID NO: 138076 - RNA, 23 nt, Human
cuagccucugcuggagugcagug

SEQ ID NO: 138077 - RNA, 27 nt, Human
aaacagccacaccccuccuccaguccu

SEQ ID NO: 138078 - RNA, 26 nt, Human
ugggaggcaugggaaacagugcagug

SEQ ID NO: 138079 - RNA, 21 nt, Human
uaucucaguuaugaguauaau

SEQ ID NO: 138080 - RNA, 19 nt, Human
cuguguacccauacugcag

SEQ ID NO: 138081 - RNA, 22 nt, Human
gucuugguucucccaggagcuc

SEQ ID NO: 138082 - RNA, 23 nt, Human
ccucucccuacucccaucccauu

SEQ ID NO: 138083 - RNA, 24 nt, Human
cauuccacuuccuccuuccccaca

SEQ ID NO: 138084 - RNA, 21 nt, Human
ggagagagggucaggagccag

SEQ ID NO: 138085 - RNA, 24 nt, Human
ccugcuggucccaccacacauggc

SEQ ID NO: 138086 - RNA, 27 nt, Human
acacuccucaagcucagugaauguauc

SEQ ID NO: 138087 - RNA, 23 nt, Human
ucaggcuucuuucaaaguguaag

SEQ ID NO: 138088 - RNA, 24 nt, Human
caggcuguugugaggacuaagggu

SEQ ID NO: 138089 - RNA, 27 nt, Human
gaaacauuacaggaaaauuauugacag

SEQ ID NO: 138090 - RNA, 26 nt, Human
ucucugagagagaugaucgugccuau

SEQ ID NO: 138091 - RNA, 26 nt, Human
cagccaucaggcuggaggugacgaug

SEQ ID NO: 138092 - RNA, 21 nt, Human
cccagccagguucucuggguc

SEQ ID NO: 138093 - RNA, 22 nt, Human
cugaggugggagaauugcuuca

SEQ ID NO: 138094 - RNA, 26 nt, Human
gcaaacacagauucccccucccccuu

SEQ ID NO: 138095 - RNA, 21 nt, Human
auuagagguccucccuucagu

SEQ ID NO: 138096 - RNA, 22 nt, Human
uaggaauaauccuuagccaugu

SEQ ID NO: 138097 - RNA, 26 nt, Human
uccaugcucaccaaggaacucuacuu

SEQ ID NO: 138098 - RNA, 24 nt, Human
uuccagcugacaucuugcacggug

SEQ ID NO: 138099 - RNA, 20 nt, Human
uaguuucaagagucuaaacc

SEQ ID NO: 138100 - RNA, 22 nt, Human
ggugccucgcgggcucagugag

SEQ ID NO: 138101 - RNA, 24 nt, Human
ucugugaacaucucaguuaccuca

SEQ ID NO: 138102 - RNA, 26 nt, Human
cugccucuguccucuuucuucuaaca

SEQ ID NO: 138103 - RNA, 21 nt, Human
agcaguuuuuaaaauagugua

SEQ ID NO: 138104 - RNA, 22 nt, Human
gacuacaggugcgugcuaccac

SEQ ID NO: 138105 - RNA, 19 nt, Human
agguccaccaccuccaucu

SEQ ID NO: 138106 - RNA, 30 nt, Human
ggcguuuguaaugagagcacuuucuuuuuu

SEQ ID NO: 138107 - RNA, 23 nt, Human
agguaggaacaagaugagcuuga

SEQ ID NO: 138108 - RNA, 23 nt, Human
gaggaagaaaugcuagccuggaa

SEQ ID NO: 138109 - RNA, 24 nt, Human
gcagguugcugugccugauucaca

SEQ ID NO: 138110 - RNA, 27 nt, Human
gggcagguacgagucggcucagccugg

SEQ ID NO: 138111 - RNA, 20 nt, Human
cauugcacuucagccuggug

SEQ ID NO: 138112 - RNA, 21 nt, Human
ugagccaaaauugcaccacug

SEQ ID NO: 138113 - RNA, 24 nt, Human
aaucucuuuggucaaaugcacauu

SEQ ID NO: 138114 - RNA, 27 nt, Human
cgucugacugucccuguggacucucuc

SEQ ID NO: 138115 - RNA, 21 nt, Human
guguucuccuuuuccucucuc

SEQ ID NO: 138116 - RNA, 22 nt, Human
cgugugccaggcagauccucug

SEQ ID NO: 138117 - RNA, 20 nt, Human
ccuccuccuccuccuggccc

SEQ ID NO: 138118 - RNA, 22 nt, Human
ucuccauccuucgaccuucaca

SEQ ID NO: 138119 - RNA, 18 nt, Human
cgcaagcucucagcaagu

SEQ ID NO: 138120 - RNA, 26 nt, Human
aggguccacacuugugauucucaaug

SEQ ID NO: 138121 - RNA, 21 nt, Human
auucugucuggucaucccaca

SEQ ID NO: 138122 - RNA, 23 nt, Human
auaaagugaauuuuaaaaaaguu

SEQ ID NO: 138123 - RNA, 21 nt, Human
cuccucacauuccagcacuuu

SEQ ID NO: 138124 - RNA, 22 nt, Human
gacuucccaaagugcugggauu

SEQ ID NO: 138125 - RNA, 22 nt, Human
gggagagaacaaggccucccag

SEQ ID NO: 138126 - RNA, 23 nt, Human
aaagguuuucacauuuuauaagg

SEQ ID NO: 138127 - RNA, 25 nt, Human
ucuguaacccagcuauucaagaggc

SEQ ID NO: 138128 - RNA, 21 nt, Human
cccauaaacaacaggagccuu

SEQ ID NO: 138129 - RNA, 21 nt, Human
ggcucacaacguuugaccucg

SEQ ID NO: 138130 - RNA, 27 nt, Human
ggucuuguguugcuucuggucucucca

SEQ ID NO: 138131 - RNA, 25 nt, Human
guugcccaggcugcucuugaauucc

SEQ ID NO: 138132 - RNA, 19 nt, Human
uagccuuuuguuaacuaau

SEQ ID NO: 138133 - RNA, 22 nt, Human
gggagcugggguuugggaaugu

SEQ ID NO: 138134 - RNA, 26 nt, Human
gcccucccucucccccucauaacccc

SEQ ID NO: 138135 - RNA, 25 nt, Human
agcucacuagccuucauauaugccu

SEQ ID NO: 138136 - RNA, 21 nt, Human
ggaggagagcggcuguggaga

SEQ ID NO: 138137 - RNA, 20 nt, Human
uucugccaguauauuuugga

SEQ ID NO: 138138 - RNA, 22 nt, Human
ccacugcacuccagacugggug

SEQ ID NO: 138139 - RNA, 22 nt, Human
uauuguaaccuuccucauuuca

SEQ ID NO: 138140 - RNA, 21 nt, Human
gaacaaauaccuggauaagag

SEQ ID NO: 138141 - RNA, 20 nt, Human
cauguacugagacaaaaagg

SEQ ID NO: 138142 - RNA, 20 nt, Human
agccucuucccuuucucacu

SEQ ID NO: 138143 - RNA, 22 nt, Human
ugucuucuguaggaugugucac

SEQ ID NO: 138144 - RNA, 26 nt, Human
uccuauugaagacaagagcaauagua

SEQ ID NO: 138145 - RNA, 20 nt, Human
ucuucauuuuagugcuuuac

SEQ ID NO: 138146 - RNA, 21 nt, Human
agcuccagcaucugugccccu

SEQ ID NO: 138147 - RNA, 26 nt, Human
cucugcugagaaggcaaacugaggca

SEQ ID NO: 138148 - RNA, 21 nt, Human
uugcuacccgcccauucaguu

SEQ ID NO: 138149 - RNA, 25 nt, Human
cugccucaccagcccuggcaacugc

SEQ ID NO: 138150 - RNA, 19 nt, Human
gaacugcaccguuacuuua

SEQ ID NO: 138151 - RNA, 24 nt, Human
uuucuauuauauaaccagcacuua

SEQ ID NO: 138152 - RNA, 24 nt, Human
gccagugcccagggccacagcccg

SEQ ID NO: 138153 - RNA, 20 nt, Human
gcauugucccagucuguucc

SEQ ID NO: 138154 - RNA, 27 nt, Human
agcaaggaaagugccugguaggacuga

SEQ ID NO: 138155 - RNA, 26 nt, Human
ucucagcccuuuauucaagccucaga

SEQ ID NO: 138156 - RNA, 22 nt, Human
agagugcugggauuacaauugu

SEQ ID NO: 138157 - RNA, 23 nt, Human
guacagccacagcaaggagcccg

SEQ ID NO: 138158 - RNA, 22 nt, Human
agaaaacauugccauuuugguu

SEQ ID NO: 138159 - RNA, 22 nt, Human
gucugucugcucaggacacaag

SEQ ID NO: 138160 - RNA, 22 nt, Human
aaacccaggcggcagagguugc

SEQ ID NO: 138161 - RNA, 27 nt, Human
ccagcacuucccugccucccccaggcc

SEQ ID NO: 138162 - RNA, 27 nt, Human
ugucugcaaacauuaaaggaaugaaac

SEQ ID NO: 138163 - RNA, 21 nt, Human
aaagagaguuuuuagugaagu

SEQ ID NO: 138164 - RNA, 24 nt, Human
cugauacugcugagucagacuguc

SEQ ID NO: 138165 - RNA, 27 nt, Human
cgcagcccaggguagggagaaauauuc

SEQ ID NO: 138166 - RNA, 22 nt, Human
caaacuccugaacccuaguaau

SEQ ID NO: 138167 - RNA, 22 nt, Human
aagggaggggaggccgagaguc

SEQ ID NO: 138168 - RNA, 18 nt, Human
augaguguguuuuguaca

SEQ ID NO: 138169 - RNA, 21 nt, Human
gcacccuagaggacuagggua

SEQ ID NO: 138170 - RNA, 22 nt, Human
ccaccuccccuucuuuuggacu

SEQ ID NO: 138171 - RNA, 23 nt, Human
uccagccaauaggcagcuuucuu

SEQ ID NO: 138172 - RNA, 21 nt, Human
uaaccagcccacagagcucac

SEQ ID NO: 138173 - RNA, 23 nt, Human
uagcuuuuuccuggaaaagcccg

SEQ ID NO: 138174 - RNA, 22 nt, Human
ggaccacgaauauucuuucugu

SEQ ID NO: 138175 - RNA, 26 nt, Human
aggcagcaagguggccacagugucac

SEQ ID NO: 138176 - RNA, 24 nt, Human
ggcucacugcagccucagcguccu

SEQ ID NO: 138177 - RNA, 23 nt, Human
gccugcccaugccagcacuuccu

SEQ ID NO: 138178 - RNA, 26 nt, Human
agagaggccuuuuggaauguggcccc

SEQ ID NO: 138179 - RNA, 19 nt, Human
gguggcguccggggugggg

SEQ ID NO: 138180 - RNA, 22 nt, Human
cacuuccuggguucacaugauu

SEQ ID NO: 138181 - RNA, 21 nt, Human
gaacagcuugaccauuuagaa

SEQ ID NO: 138182 - RNA, 25 nt, Human
aaacucaucaguucauccggcauca

SEQ ID NO: 138183 - RNA, 26 nt, Human
auagccgccuccgccucugcccgccu

SEQ ID NO: 138184 - RNA, 30 nt, Human
uuuccaggugggcaugguuuauuucccagu

SEQ ID NO: 138185 - RNA, 21 nt, Human
ggaauagaagugcaagcugga

SEQ ID NO: 138186 - RNA, 22 nt, Human
guugaaaucugccuuuuucuca

SEQ ID NO: 138187 - RNA, 22 nt, Human
gcagagucacccacagggccag

SEQ ID NO: 138188 - RNA, 21 nt, Human
auuuuuggucucugugugucu

SEQ ID NO: 138189 - RNA, 22 nt, Human
ucugugcugaggaccucaggga

SEQ ID NO: 138190 - RNA, 24 nt, Human
gaugucgaugacagacuugcugaa

SEQ ID NO: 138191 - RNA, 21 nt, Human
cgccaucaagguccaguggaa

SEQ ID NO: 138192 - RNA, 20 nt, Human
caauuucagcacccaacuga

SEQ ID NO: 138193 - RNA, 26 nt, Human
ccuaacucugcccacccuccuguacc

SEQ ID NO: 138194 - RNA, 25 nt, Human
gccucucccccuuuccucgacagcu

SEQ ID NO: 138195 - RNA, 27 nt, Human
cuccugaccuugugauuugcccgccuc

SEQ ID NO: 138196 - RNA, 27 nt, Human
cgauauugaggaagcacaggacaucca

SEQ ID NO: 138197 - RNA, 22 nt, Human
ccauagcugcucggacaguguc

SEQ ID NO: 138198 - RNA, 27 nt, Human
aguucucucuuccuuccccugcauaga

SEQ ID NO: 138199 - RNA, 24 nt, Human
cugcuucucaauaucauagacaca

SEQ ID NO: 138200 - RNA, 21 nt, Human
agaguagcacauuaaagugau

SEQ ID NO: 138201 - RNA, 22 nt, Human
cccagaggaaccugaggccuga

SEQ ID NO: 138202 - RNA, 26 nt, Human
accauccugaagccagcuugcaccuc

SEQ ID NO: 138203 - RNA, 23 nt, Human
cagaaaagugggcagugguggca

SEQ ID NO: 138204 - RNA, 22 nt, Human
caagaauuucuaaaaaugagug

SEQ ID NO: 138205 - RNA, 22 nt, Human
ggaugcauacaccugccugcag

SEQ ID NO: 138206 - RNA, 18 nt, Human
ugaaaggccucacugugg

SEQ ID NO: 138207 - RNA, 22 nt, Human
acgugccugaaacugugcuuaa

SEQ ID NO: 138208 - RNA, 22 nt, Human
caccauuuaauuucauguaaua

SEQ ID NO: 138209 - RNA, 22 nt, Human
gcuuggggcuggccaaugggga

SEQ ID NO: 138210 - RNA, 20 nt, Human
ggccucuccaugccuucuua

SEQ ID NO: 138211 - RNA, 21 nt, Human
guagacauaucuaauaguggu

SEQ ID NO: 138212 - RNA, 26 nt, Human
uucggccuccaucuccugggacccgc

SEQ ID NO: 138213 - RNA, 22 nt, Human
gguuacuuauuuuuucuuuuug

SEQ ID NO: 138214 - RNA, 20 nt, Human
ugagaccccccaccaccagc

SEQ ID NO: 138215 - RNA, 21 nt, Human
gaauuucuugcucugaaggag

SEQ ID NO: 138216 - RNA, 23 nt, Human
gcauugcaucuucugugccuagc

SEQ ID NO: 138217 - RNA, 21 nt, Human
ccccucacuccacccugaggg

SEQ ID NO: 138218 - RNA, 27 nt, Human
ccacugcacuccagucuggcaacagag

SEQ ID NO: 138219 - RNA, 23 nt, Human
acuaaguugcugagacaagggaa

SEQ ID NO: 138220 - RNA, 24 nt, Human
gcaggcauugaggaagagucuugg

SEQ ID NO: 138221 - RNA, 25 nt, Human
aaccccagccccagccucagcccug

SEQ ID NO: 138222 - RNA, 24 nt, Human
gguagcucacaccuguaaucccag

SEQ ID NO: 138223 - RNA, 24 nt, Human
accaggcccagaaggaaccagcca

SEQ ID NO: 138224 - RNA, 24 nt, Human
uaccagguuuuacacuugcaucuc

SEQ ID NO: 138225 - RNA, 24 nt, Human
gggcuccucccaugccuccugcac

SEQ ID NO: 138226 - RNA, 18 nt, Human
ccaugcgguucucucaca

SEQ ID NO: 138227 - RNA, 21 nt, Human
gguugcagaaagaaaaaagaa

SEQ ID NO: 138228 - RNA, 22 nt, Human
agcauuucagcaugauauugca

SEQ ID NO: 138229 - RNA, 19 nt, Human
guaccacauaacaacaucu

SEQ ID NO: 138230 - RNA, 22 nt, Human
cacgccuguaaucccagaacuu

SEQ ID NO: 138231 - RNA, 22 nt, Human
cccgccuguaaucccagcacuu

SEQ ID NO: 138232 - RNA, 22 nt, Human
cacgccugucaucccagcacuu

SEQ ID NO: 138233 - RNA, 21 nt, Human
agaagcuccagguagagggug

SEQ ID NO: 138234 - RNA, 25 nt, Human
uugugucugugccccuguguguguu

SEQ ID NO: 138235 - RNA, 21 nt, Human
uuguacacucuuuucucuccc

SEQ ID NO: 138236 - RNA, 22 nt, Human
ccugacaucucgagguuuccuc

SEQ ID NO: 138237 - RNA, 20 nt, Human
cccaaggcaaaaacuaccuu

SEQ ID NO: 138238 - RNA, 22 nt, Human
ccggaguagcugggauuacagg

SEQ ID NO: 138239 - RNA, 27 nt, Human
cucuucagugggucaucugugugucac

SEQ ID NO: 138240 - RNA, 21 nt, Human
aguucugcuuucugccucucc

SEQ ID NO: 138241 - RNA, 24 nt, Human
uggagagagaauuaucuugcucaa

SEQ ID NO: 138242 - RNA, 21 nt, Human
aauccuccucugcuccagggc

SEQ ID NO: 138243 - RNA, 22 nt, Human
cuggagauaguuuucacuuuua

SEQ ID NO: 138244 - RNA, 20 nt, Human
ccuuucucaccgcagucguc

SEQ ID NO: 138245 - RNA, 20 nt, Human
agaccucucaauuucuggaa

SEQ ID NO: 138246 - RNA, 28 nt, Human
uccucccaagauccccuggaggaggagg

SEQ ID NO: 138247 - RNA, 26 nt, Human
cgagguuuuagaagcagagucaggcg

SEQ ID NO: 138248 - RNA, 22 nt, Human
ccuggaguguugaggggguugu

SEQ ID NO: 138249 - RNA, 26 nt, Human
uguuuuaauuucuguuuguaucagua

SEQ ID NO: 138250 - RNA, 20 nt, Human
uagaaccuggcuugccuccc

SEQ ID NO: 138251 - RNA, 21 nt, Human
aauauaaaucacagauuucca

SEQ ID NO: 138252 - RNA, 20 nt, Human
agagagugaggcuggggguu

SEQ ID NO: 138253 - RNA, 22 nt, Human
gggcagagaagaaaaugaccag

SEQ ID NO: 138254 - RNA, 25 nt, Human
gaaaccaagaaacacuacuauuaaa

SEQ ID NO: 138255 - RNA, 24 nt, Human
aaacaguguacaguauuuuucuca

SEQ ID NO: 138256 - RNA, 23 nt, Human
ggaggaagaagauuuaucuuuuc

SEQ ID NO: 138257 - RNA, 19 nt, Human
cggaaggcaguggguguga

SEQ ID NO: 138258 - RNA, 21 nt, Human
gcaguuucaguccauaucaau

SEQ ID NO: 138259 - RNA, 22 nt, Human
ccaggccuccccgaaaccaaag

SEQ ID NO: 138260 - RNA, 19 nt, Human
ggcuauacuccagcuggcc

SEQ ID NO: 138261 - RNA, 27 nt, Human
gaggaagagcaagacuguccccuaugc

SEQ ID NO: 138262 - RNA, 26 nt, Human
ccaagaaugagaagaaugacuaugca

SEQ ID NO: 138263 - RNA, 22 nt, Human
cccauaaauaacaugaaugaaa

SEQ ID NO: 138264 - RNA, 24 nt, Human
uacagaagagcaguugaagugauu

SEQ ID NO: 138265 - RNA, 27 nt, Human
cuggcuccccuucaccuucugccauga

SEQ ID NO: 138266 - RNA, 22 nt, Human
uuucagcuugacacagguuugg

SEQ ID NO: 138267 - RNA, 31 nt, Human
uuguuuucaaccucauguaauuugugcagau

SEQ ID NO: 138268 - RNA, 18 nt, Human
cagugccaccgccaccac

SEQ ID NO: 138269 - RNA, 23 nt, Human
ccuucccuucccuguccuggguc

SEQ ID NO: 138270 - RNA, 22 nt, Human
ugucgugagcuaugauuaugcc

SEQ ID NO: 138271 - RNA, 26 nt, Human
ggaauucugccuaaguugucugccuu

SEQ ID NO: 138272 - RNA, 19 nt, Human
ccacggacuccccuuggcc

SEQ ID NO: 138273 - RNA, 22 nt, Human
gaccugccuucugauuggaggc

SEQ ID NO: 138274 - RNA, 19 nt, Human
aaagaaugucuuggaaugc

SEQ ID NO: 138275 - RNA, 19 nt, Human
cucgaauuuccaaaagagg

SEQ ID NO: 138276 - RNA, 27 nt, Human
ucauggcaucaaggcucacugcagccu

SEQ ID NO: 138277 - RNA, 27 nt, Human
cuaccugcccuugggcucacuaauauc

SEQ ID NO: 138278 - RNA, 21 nt, Human
gggaaaaaagaaaaaccugcu

SEQ ID NO: 138279 - RNA, 20 nt, Human
gcuaucuccuauaccaauaa

SEQ ID NO: 138280 - RNA, 23 nt, Human
uuucugcuucauuacuggacuag

SEQ ID NO: 138281 - RNA, 22 nt, Human
gaacucuuggccucaagcgauc

SEQ ID NO: 138282 - RNA, 20 nt, Human
uauuaaaaugacuauuucua

SEQ ID NO: 138283 - RNA, 23 nt, Human
caaaucuuaaaugagaccaaagu

SEQ ID NO: 138284 - RNA, 21 nt, Human
aucaugacauguuauauauuu

SEQ ID NO: 138285 - RNA, 22 nt, Human
ccagccauguugcccaggcugg

SEQ ID NO: 138286 - RNA, 23 nt, Human
gacugcugguugacaucagaccc

SEQ ID NO: 138287 - RNA, 21 nt, Human
gcagccucuaacuccugggcu

SEQ ID NO: 138288 - RNA, 26 nt, Human
ugcuaccucaucuugccacugcagug

SEQ ID NO: 138289 - RNA, 25 nt, Human
aagaggggcagugggagcagaggag

SEQ ID NO: 138290 - RNA, 26 nt, Human
uacuguacuccagccagggcaagaga

SEQ ID NO: 138291 - RNA, 22 nt, Human
gaccagccuaggugacauagug

SEQ ID NO: 138292 - RNA, 26 nt, Human
agcuaaauauauacucuucucuaguu

SEQ ID NO: 138293 - RNA, 21 nt, Human
gagcaccccacccccagcgag

SEQ ID NO: 138294 - RNA, 20 nt, Human
accauguccacaauggugua

SEQ ID NO: 138295 - RNA, 21 nt, Human
auugacuuuaauuuaaaacaa

SEQ ID NO: 138296 - RNA, 24 nt, Human
ugguuuuauuaguacccuggucau

SEQ ID NO: 138297 - RNA, 19 nt, Human
caggugaggagcaggcucc

SEQ ID NO: 138298 - RNA, 22 nt, Human
ggggcugugcuggggcuugggg

SEQ ID NO: 138299 - RNA, 20 nt, Human
ggcuggggguagaaauguca

SEQ ID NO: 138300 - RNA, 23 nt, Human
cuugcccagcucuugaguacagu

SEQ ID NO: 138301 - RNA, 24 nt, Human
cuguuacccaggcuggagugcagu

SEQ ID NO: 138302 - RNA, 24 nt, Human
cugucacccagguuggagugcagu

SEQ ID NO: 138303 - RNA, 24 nt, Human
cuguugcccaggcuggagugcggu

SEQ ID NO: 138304 - RNA, 25 nt, Human
acucauagccauguccacauggggg

SEQ ID NO: 138305 - RNA, 22 nt, Human
aaagugauggaauuacaggugu

SEQ ID NO: 138306 - RNA, 26 nt, Human
gacuauacacuuucuuuugaacuuuu

SEQ ID NO: 138307 - RNA, 24 nt, Human
agugaagccucugagggauugagg

SEQ ID NO: 138308 - RNA, 26 nt, Human
uuacuuccuucuguuuucuguccaug

SEQ ID NO: 138309 - RNA, 26 nt, Human
agaaaugcuaaauauuuuguuucucg

SEQ ID NO: 138310 - RNA, 25 nt, Human
ucccugcacuaagaagaaucacuuu

SEQ ID NO: 138311 - RNA, 26 nt, Human
ucaucucagcaagaauguggcaccuu

SEQ ID NO: 138312 - RNA, 29 nt, Human
ggcagcgccuccuccucuccuccuccucc

SEQ ID NO: 138313 - RNA, 21 nt, Human
gcuagcaccagugccagcucc

SEQ ID NO: 138314 - RNA, 24 nt, Human
ugaauuuaauacagacaucuaaug

SEQ ID NO: 138315 - RNA, 18 nt, Human
uacagugucagaugagga

SEQ ID NO: 138316 - RNA, 27 nt, Human
agggaaaggccagugugaaccgagggg

SEQ ID NO: 138317 - RNA, 22 nt, Human
auaaaaaauauuccaacuagaa

SEQ ID NO: 138318 - RNA, 22 nt, Human
ucuuccauguggagguauucaa

SEQ ID NO: 138319 - RNA, 23 nt, Human
cuccacugagggcgccuaacucu

SEQ ID NO: 138320 - RNA, 20 nt, Human
ugagcagccuuucugcugau

SEQ ID NO: 138321 - RNA, 27 nt, Human
uuuccaaagugcagccacagcuacaau

SEQ ID NO: 138322 - RNA, 24 nt, Human
gauucaucuuuauucccuccauca

SEQ ID NO: 138323 - RNA, 27 nt, Human
ggugcagcuuugggacagaugaguggc

SEQ ID NO: 138324 - RNA, 27 nt, Human
ucucccaggcuggagugcaaucgcgca

SEQ ID NO: 138325 - RNA, 23 nt, Human
ugugccuguaaucccagcuauuu

SEQ ID NO: 138326 - RNA, 20 nt, Human
cucagugucauuuaugaaaa

SEQ ID NO: 138327 - RNA, 21 nt, Human
caguugagagcggggauguga

SEQ ID NO: 138328 - RNA, 24 nt, Human
ugggcggggcuggaugggcugugg

SEQ ID NO: 138329 - RNA, 27 nt, Human
aagugcacacauugcugagagccgucu

SEQ ID NO: 138330 - RNA, 22 nt, Human
ucaugccagcucauuacagcau

SEQ ID NO: 138331 - RNA, 25 nt, Human
gaggggagaccuuaagaauuuugac

SEQ ID NO: 138332 - RNA, 22 nt, Human
cugaggcagaaggauuaccuga

SEQ ID NO: 138333 - RNA, 24 nt, Human
cacagccgccuuuuugcggccugg

SEQ ID NO: 138334 - RNA, 25 nt, Human
cagucucucucuuccucacaguccc

SEQ ID NO: 138335 - RNA, 19 nt, Human
ggagaauagcacaauccag

SEQ ID NO: 138336 - RNA, 25 nt, Human
ggacuucucauuggccaaccugccu

SEQ ID NO: 138337 - RNA, 22 nt, Human
uugcccaagcuggagugaagug

SEQ ID NO: 138338 - RNA, 22 nt, Human
gcucacugcaaccaccaucucc

SEQ ID NO: 138339 - RNA, 23 nt, Human
gccucauuccuccuguucuccca

SEQ ID NO: 138340 - RNA, 23 nt, Human
ccaaauggugugaacccaggggg

SEQ ID NO: 138341 - RNA, 21 nt, Human
ucgucccuacuuccuccuccg

SEQ ID NO: 138342 - RNA, 26 nt, Human
cugccucugcugaguguaccugacag

SEQ ID NO: 138343 - RNA, 27 nt, Human
ggucuugaacuccugaccucgugaucc

SEQ ID NO: 138344 - RNA, 21 nt, Human
gagggaaagagacccagaaag

SEQ ID NO: 138345 - RNA, 20 nt, Human
ggcuaguuaaggugugcaaa

SEQ ID NO: 138346 - RNA, 17 nt, Human
uuuguauuuuguacaaa

SEQ ID NO: 138347 - RNA, 18 nt, Human
ugaaggcaggggugguga

SEQ ID NO: 138348 - RNA, 21 nt, Human
ccaaauuuucauuucuccaca

SEQ ID NO: 138349 - RNA, 27 nt, Human
ugccaugaacuggaggccaggaaucuc

SEQ ID NO: 138350 - RNA, 21 nt, Human
ggcgaacuagaacacugggaa

SEQ ID NO: 138351 - RNA, 27 nt, Human
gcccucgcuuuaccggaguagggggug

SEQ ID NO: 138352 - RNA, 23 nt, Human
ccaccgucccacuccacagccuu

SEQ ID NO: 138353 - RNA, 23 nt, Human
cauugcuaaccccaaacaggcau

SEQ ID NO: 138354 - RNA, 20 nt, Human
agaucugggccuccugcugc

SEQ ID NO: 138355 - RNA, 26 nt, Human
ugauauaugccuauaauauaagccau

SEQ ID NO: 138356 - RNA, 27 nt, Human
ccaacccauguggaucuaaggcaaauu

SEQ ID NO: 138357 - RNA, 23 nt, Human
accaggcaccucuuccuugaugu

SEQ ID NO: 138358 - RNA, 21 nt, Human
acucauuccuucccaccccca

SEQ ID NO: 138359 - RNA, 27 nt, Human
gcuggccucucuggcugggugcaguga

SEQ ID NO: 138360 - RNA, 21 nt, Human
cugucggaaccaggacacaaa

SEQ ID NO: 138361 - RNA, 26 nt, Human
uuuccucugcccacuaaucccugcgc

SEQ ID NO: 138362 - RNA, 23 nt, Human
agaugcauuuguccagugcccca

SEQ ID NO: 138363 - RNA, 21 nt, Human
acuaagcuauaucucuaacac

SEQ ID NO: 138364 - RNA, 27 nt, Human
auuuugaaaucuccugucuuuuuaaac

SEQ ID NO: 138365 - RNA, 21 nt, Human
cuuugcagugagugcugcuca

SEQ ID NO: 138366 - RNA, 22 nt, Human
ucuuccuuccuccuccucccca

SEQ ID NO: 138367 - RNA, 21 nt, Human
cacccaggcugaagugcagug

SEQ ID NO: 138368 - RNA, 24 nt, Human
uuuccuccuucauccuguggaguc

SEQ ID NO: 138369 - RNA, 22 nt, Human
ccgaguaguugggauuacaggu

SEQ ID NO: 138370 - RNA, 26 nt, Human
ugcagcucucaugcugccccugccuu

SEQ ID NO: 138371 - RNA, 22 nt, Human
aucugaaaucauguaucugucu

SEQ ID NO: 138372 - RNA, 26 nt, Human
uugcucuuagucccaagcuaggcuua

SEQ ID NO: 138373 - RNA, 22 nt, Human
aguccagccugggcagcauagu

SEQ ID NO: 138374 - RNA, 23 nt, Human
uucucuaugguggacaaaguuca

SEQ ID NO: 138375 - RNA, 22 nt, Human
caccuccuggguuuaagcgauu

SEQ ID NO: 138376 - RNA, 22 nt, Human
uccugagccagaggccaggucu

SEQ ID NO: 138377 - RNA, 23 nt, Human
gcucuggcuggagaggaaaagcc

SEQ ID NO: 138378 - RNA, 20 nt, Human
uuucaaguaaauucagggaa

SEQ ID NO: 138379 - RNA, 20 nt, Human
aggugcaagagacagagccc

SEQ ID NO: 138380 - RNA, 24 nt, Human
guaacaccagugaaaccccacacu

SEQ ID NO: 138381 - RNA, 27 nt, Human
cugccuugcaauaaauuuuucucucua

SEQ ID NO: 138382 - RNA, 22 nt, Human
ucgcggguccugcagugcccca

SEQ ID NO: 138383 - RNA, 18 nt, Human
uguaauuuugucuuugga

SEQ ID NO: 138384 - RNA, 20 nt, Human
cucucucugacgggguggca

SEQ ID NO: 138385 - RNA, 22 nt, Human
ucugaacuaggugaucucaguu

SEQ ID NO: 138386 - RNA, 24 nt, Human
cauauuccaucaccuuccuccucu

SEQ ID NO: 138387 - RNA, 27 nt, Human
uaagagauggcauuagagggagcccag

SEQ ID NO: 138388 - RNA, 23 nt, Human
gagccauggacucuacacuguga

SEQ ID NO: 138389 - RNA, 21 nt, Human
gucugaggggacaggaggauc

SEQ ID NO: 138390 - RNA, 20 nt, Human
cauucuuucuuucuggguga

SEQ ID NO: 138391 - RNA, 26 nt, Human
gaaagaagaaacucccaggaauugga

SEQ ID NO: 138392 - RNA, 22 nt, Human
aaagcaauaaaugaaugggcug

SEQ ID NO: 138393 - RNA, 21 nt, Human
uauguauaaaaauaacuuucu

SEQ ID NO: 138394 - RNA, 24 nt, Human
ggaggucgggcggggcagaggggc

SEQ ID NO: 138395 - RNA, 23 nt, Human
cggucucuuccucggaaaggcag

SEQ ID NO: 138396 - RNA, 30 nt, Human
cuaaaucagaugacugaaucugccuaaaac

SEQ ID NO: 138397 - RNA, 20 nt, Human
uaucuccccuccucucucuc

SEQ ID NO: 138398 - RNA, 27 nt, Human
gacuggguagaggccaggagaaaggaa

SEQ ID NO: 138399 - RNA, 20 nt, Human
uuguuuguuagaccuguguc

SEQ ID NO: 138400 - RNA, 28 nt, Human
ccagcgucuccggcagccucuuggucau

SEQ ID NO: 138401 - RNA, 24 nt, Human
aggcuggagugcagugacgcgauc

SEQ ID NO: 138402 - RNA, 21 nt, Human
gagccagaucuggagugcgag

SEQ ID NO: 138403 - RNA, 21 nt, Human
ccaugcugggguuagaugugu

SEQ ID NO: 138404 - RNA, 31 nt, Human
cucugcaaaaucgucccuuguggagaaugca

SEQ ID NO: 138405 - RNA, 21 nt, Human
cuuuaguauuccuguaauacu

SEQ ID NO: 138406 - RNA, 23 nt, Human
cuucuaggaauggaggagccagg

SEQ ID NO: 138407 - RNA, 20 nt, Human
cagcagcugaaggcacccag

SEQ ID NO: 138408 - RNA, 24 nt, Human
agacucagaauccacaguguccca

SEQ ID NO: 138409 - RNA, 20 nt, Human
cacagcaugggcagugccuu

SEQ ID NO: 138410 - RNA, 22 nt, Human
uggcugaagugugguguggcuc

SEQ ID NO: 138411 - RNA, 21 nt, Human
uauaguuuuaauuucucucua

SEQ ID NO: 138412 - RNA, 22 nt, Human
cucagcaccugagccucccuca

SEQ ID NO: 138413 - RNA, 27 nt, Human
uucugaccuucccgggacacauucuuc

SEQ ID NO: 138414 - RNA, 19 nt, Human
uggacaccacacaccagcu

SEQ ID NO: 138415 - RNA, 22 nt, Human
cucaugagcucauccaagccaa

SEQ ID NO: 138416 - RNA, 21 nt, Human
gcaugggcugccagguuuugu

SEQ ID NO: 138417 - RNA, 18 nt, Human
ugcuguuuuuguucuacu

SEQ ID NO: 138418 - RNA, 24 nt, Human
gcucagcccaggcacaacuucagc

SEQ ID NO: 138419 - RNA, 21 nt, Human
ucaucugcaccauguccccgg

SEQ ID NO: 138420 - RNA, 24 nt, Human
cgauguacacugauguucaucuca

SEQ ID NO: 138421 - RNA, 22 nt, Human
gcccaggcuggagugcagucgu

SEQ ID NO: 138422 - RNA, 23 nt, Human
cccuucaaguaaaccaucccuga

SEQ ID NO: 138423 - RNA, 23 nt, Human
aaagacaauuuuccuuggaacac

SEQ ID NO: 138424 - RNA, 18 nt, Human
ggacauuuaacuaggcau

SEQ ID NO: 138425 - RNA, 27 nt, Human
cccaagcaccugggauuacaagcauga

SEQ ID NO: 138426 - RNA, 22 nt, Human
ccaaggaguggaggucagagug

SEQ ID NO: 138427 - RNA, 21 nt, Human
ucucgcgccuccuagcucuuc

SEQ ID NO: 138428 - RNA, 27 nt, Human
acuuuaagcuccuugaguaaaaaggug

SEQ ID NO: 138429 - RNA, 24 nt, Human
acaggucccuuugaagaacugaca

SEQ ID NO: 138430 - RNA, 20 nt, Human
agacaguaacuuuacacuuc

SEQ ID NO: 138431 - RNA, 21 nt, Human
auccaguuccuucaaagugau

SEQ ID NO: 138432 - RNA, 28 nt, Human
cgcuggucccucugggcaugcugugcuc

SEQ ID NO: 138433 - RNA, 20 nt, Human
ggaggcagagguugcaguga

SEQ ID NO: 138434 - RNA, 26 nt, Human
cuggaaggcaggugugcccgucagcg

SEQ ID NO: 138435 - RNA, 22 nt, Human
aggcugaggcagaaggauuacc

SEQ ID NO: 138436 - RNA, 24 nt, Human
uguguggagaacucagugccacac

SEQ ID NO: 138437 - RNA, 24 nt, Human
uaguucucuucuucuaggaaccau

SEQ ID NO: 138438 - RNA, 21 nt, Human
ggggguggagguugcagugag

SEQ ID NO: 138439 - RNA, 21 nt, Human
ggagguggagguugcaguaag

SEQ ID NO: 138440 - RNA, 21 nt, Human
ggaaguggcaguugcagugag

SEQ ID NO: 138441 - RNA, 27 nt, Human
ucaucccagcguaugcugccucuuuag

SEQ ID NO: 138442 - RNA, 21 nt, Human
ccugcaauuucccaccuccug

SEQ ID NO: 138443 - RNA, 32 nt, Human
caggcaucuuugccugcccugccuugcuuggc

SEQ ID NO: 138444 - RNA, 23 nt, Human
guguuuaaaguggcuuucuggcc

SEQ ID NO: 138445 - RNA, 23 nt, Human
caugucggcucugccugcaguga

SEQ ID NO: 138446 - RNA, 17 nt, Human
ccccaaaacacuaccau

SEQ ID NO: 138447 - RNA, 23 nt, Human
gcacuuuuuauuuucauuuucug

SEQ ID NO: 138448 - RNA, 22 nt, Human
uagaaucugauuucaccucuca

SEQ ID NO: 138449 - RNA, 17 nt, Human
aguuuaggcuggaaaug

SEQ ID NO: 138450 - RNA, 24 nt, Human
ccugcacacaccugccugcagagc

SEQ ID NO: 138451 - RNA, 26 nt, Human
cucuccucucuugaaaguucucugcu

SEQ ID NO: 138452 - RNA, 23 nt, Human
agaccagcuggggcaacauaugg

SEQ ID NO: 138453 - RNA, 23 nt, Human
ccgggaggcagaaguugcaguga

SEQ ID NO: 138454 - RNA, 21 nt, Human
acaucuucagugcagaaggaa

SEQ ID NO: 138455 - RNA, 22 nt, Human
gcggccaguccagccuuuuaaa

SEQ ID NO: 138456 - RNA, 26 nt, Human
agggaaaguguuucuuggguuuggaa

SEQ ID NO: 138457 - RNA, 25 nt, Human
uugaggcuuuuguuauaccaaggaa

SEQ ID NO: 138458 - RNA, 20 nt, Human
cuucugcucauuacuacacu

SEQ ID NO: 138459 - RNA, 19 nt, Human
cgcagcuuugggccugguc

SEQ ID NO: 138460 - RNA, 20 nt, Human
uucuccuucuucugauccag

SEQ ID NO: 138461 - RNA, 25 nt, Human
ggcccaguuuuggggugugaccuca

SEQ ID NO: 138462 - RNA, 24 nt, Human
gcccaggcuggagugcaauggcau

SEQ ID NO: 138463 - RNA, 16 nt, Human
agugacugcuuugcca

SEQ ID NO: 138464 - RNA, 23 nt, Human
ccauauuuauucaagauguuuua

SEQ ID NO: 138465 - RNA, 27 nt, Human
ugaucucaugacuauuaaaauguugcu

SEQ ID NO: 138466 - RNA, 23 nt, Human
aaaugcuuauuguauugagaacc

SEQ ID NO: 138467 - RNA, 22 nt, Human
agcauuguguauagaacuggau

SEQ ID NO: 138468 - RNA, 22 nt, Human
ggcuaguuucuguauuuuuagu

SEQ ID NO: 138469 - RNA, 18 nt, Human
gugugagcuuccuugggg

SEQ ID NO: 138470 - RNA, 29 nt, Human
acacucuucagaagacauuucauaccugc

SEQ ID NO: 138471 - RNA, 21 nt, Human
uugccauuuuaaauauguucu

SEQ ID NO: 138472 - RNA, 25 nt, Human
accgagcaggcacagcacagcagug

SEQ ID NO: 138473 - RNA, 23 nt, Human
acacccugggauggggcuaguag

SEQ ID NO: 138474 - RNA, 27 nt, Human
ccaaugccaucucccacuagauccugu

SEQ ID NO: 138475 - RNA, 21 nt, Human
gcuccacuguugccaaacuuu

SEQ ID NO: 138476 - RNA, 22 nt, Human
uacuggggaagaaagugaagga

SEQ ID NO: 138477 - RNA, 22 nt, Human
cagcucagagggaggagccaga

SEQ ID NO: 138478 - RNA, 26 nt, Human
cgggugugagccauugcgcccagccu

SEQ ID NO: 138479 - RNA, 18 nt, Human
acagcaaacacauucucc

SEQ ID NO: 138480 - RNA, 27 nt, Human
gcacaugcacacaggugcacagaccac

SEQ ID NO: 138481 - RNA, 26 nt, Human
uuaccuuuccugucagaaauaaacca

SEQ ID NO: 138482 - RNA, 26 nt, Human
uccagccucagagaucucccuucuca

SEQ ID NO: 138483 - RNA, 24 nt, Human
gcccaggcuggagugcaggggcgc

SEQ ID NO: 138484 - RNA, 22 nt, Human
uggucugucauugucugccuuu

SEQ ID NO: 138485 - RNA, 22 nt, Human
ucuugcccaggcuggagugcaa

SEQ ID NO: 138486 - RNA, 22 nt, Human
uaggauuacagguaugagccau

SEQ ID NO: 138487 - RNA, 23 nt, Human
gagggagggaacagugcccaagc

SEQ ID NO: 138488 - RNA, 20 nt, Human
ugcuuuccuccacugccauc

SEQ ID NO: 138489 - RNA, 21 nt, Human
agugagccagugagggcaguc

SEQ ID NO: 138490 - RNA, 23 nt, Human
cugucucucccuaaauaaauacu

SEQ ID NO: 138491 - RNA, 22 nt, Human
gacucacucagcugcuggcccc

SEQ ID NO: 138492 - RNA, 27 nt, Human
ggagaggcugaaaagaaagcagaggag

SEQ ID NO: 138493 - RNA, 26 nt, Human
cauguagguuugccaagucuuugugg

SEQ ID NO: 138494 - RNA, 21 nt, Human
ccuucugcccucccuggagcc

SEQ ID NO: 138495 - RNA, 24 nt, Human
gggaggcgugggaugggaauagca

SEQ ID NO: 138496 - RNA, 20 nt, Human
ggcugggaucccaacuaucg

SEQ ID NO: 138497 - RNA, 20 nt, Human
gagggacuugccucuguaaa

SEQ ID NO: 138498 - RNA, 21 nt, Human
ccagcccccagccacagccuu

SEQ ID NO: 138499 - RNA, 22 nt, Human
cuguagugagguugcagugauu

SEQ ID NO: 138500 - RNA, 21 nt, Human
ggugacuagaacaacuugaag

SEQ ID NO: 138501 - RNA, 23 nt, Human
aaaacauuuuacagauuuuaugg

SEQ ID NO: 138502 - RNA, 27 nt, Human
ccugggggcuggccucagucucugucc

SEQ ID NO: 138503 - RNA, 21 nt, Human
aaugcacagggaauacaauag

SEQ ID NO: 138504 - RNA, 27 nt, Human
gcugcugccuccgccacuggccaccgc

SEQ ID NO: 138505 - RNA, 23 nt, Human
cugucucuugcuuaccaaugucu

SEQ ID NO: 138506 - RNA, 27 nt, Human
augagacaaaguucuugagacauuuaa

SEQ ID NO: 138507 - RNA, 20 nt, Human
cagcaaaucacuucucuccc

SEQ ID NO: 138508 - RNA, 22 nt, Human
ugggagguagagguugcacuga

SEQ ID NO: 138509 - RNA, 19 nt, Human
cuuauagucauauauauca

SEQ ID NO: 138510 - RNA, 27 nt, Human
aaagaacaguaaacauugguaagaaug

SEQ ID NO: 138511 - RNA, 22 nt, Human
uaaugugcugcccagaaaccuc

SEQ ID NO: 138512 - RNA, 21 nt, Human
ggccacuauguuuucuaccuc

SEQ ID NO: 138513 - RNA, 23 nt, Human
ggaccccugccuuccccaggcca

SEQ ID NO: 138514 - RNA, 21 nt, Human
gccaauuuucugauuuuuugu

SEQ ID NO: 138515 - RNA, 24 nt, Human
agggggauuucuguugccuugaca

SEQ ID NO: 138516 - RNA, 25 nt, Human
cagcuggcaguggagccugcuuuau

SEQ ID NO: 138517 - RNA, 20 nt, Human
cauugugguuuuaauuucca

SEQ ID NO: 138518 - RNA, 22 nt, Human
uuaccuuugaagaaaaccagaa

SEQ ID NO: 138519 - RNA, 26 nt, Human
uucauucuuggguuaacaguaucuca

SEQ ID NO: 138520 - RNA, 27 nt, Human
ucuguucuguauuuuggcaucuguguu

SEQ ID NO: 138521 - RNA, 22 nt, Human
uucagccugcugugcagcagug

SEQ ID NO: 138522 - RNA, 24 nt, Human
ccuugggugcugaccagcagaguc

SEQ ID NO: 138523 - RNA, 20 nt, Human
ucuggcccucuaccuugcuu

SEQ ID NO: 138524 - RNA, 26 nt, Human
cgccucagccucccaaaguguuggga

SEQ ID NO: 138525 - RNA, 22 nt, Human
ccugccugggcaggcagcucgc

SEQ ID NO: 138526 - RNA, 24 nt, Human
ccucucucccugccuguuuucccc

SEQ ID NO: 138527 - RNA, 24 nt, Human
cucaccaaacccucuuccccacca

SEQ ID NO: 138528 - RNA, 23 nt, Human
uucuucuguggaguuauccuccu

SEQ ID NO: 138529 - RNA, 22 nt, Human
ggccccucuuuaaaccguguga

SEQ ID NO: 138530 - RNA, 24 nt, Human
ucucguccugcccgcacugccucu

SEQ ID NO: 138531 - RNA, 22 nt, Human
aggccagugccagcaccugccc

SEQ ID NO: 138532 - RNA, 22 nt, Human
caugcugguggccaccgugucc

SEQ ID NO: 138533 - RNA, 31 nt, Human
ccucugcccggggagccucaggcaguccucu

SEQ ID NO: 138534 - RNA, 22 nt, Human
uugcagcccaguuuaauucagc

SEQ ID NO: 138535 - RNA, 26 nt, Human
auauuuuuauaaugguuuuuaauguc

SEQ ID NO: 138536 - RNA, 24 nt, Human
gcggcuuuaagugugcugggcaga

SEQ ID NO: 138537 - RNA, 27 nt, Human
caggaaggggccgagggggcuugccca

SEQ ID NO: 138538 - RNA, 24 nt, Human
aucuuucucuguccccuccuugcc

SEQ ID NO: 138539 - RNA, 17 nt, Human
uccuuuuccuuaccaua

SEQ ID NO: 138540 - RNA, 20 nt, Human
gggaggacgccugcccacgc

SEQ ID NO: 138541 - RNA, 27 nt, Human
ccaaagugcauuugccuaggacuucuc

SEQ ID NO: 138542 - RNA, 22 nt, Human
guugcccagugugagggaaaga

SEQ ID NO: 138543 - RNA, 23 nt, Human
aguauguguggucuuguuuccuu

SEQ ID NO: 138544 - RNA, 26 nt, Human
gcacccagcccuucccccucccucau

SEQ ID NO: 138545 - RNA, 18 nt, Human
cuagauauaccauuaucc

SEQ ID NO: 138546 - RNA, 26 nt, Human
ggagagaagcaagccagccaauagaa

SEQ ID NO: 138547 - RNA, 22 nt, Human
ggagucgauaaauuagcagaac

SEQ ID NO: 138548 - RNA, 22 nt, Human
uggacagcugugccucgcuccc

SEQ ID NO: 138549 - RNA, 25 nt, Human
gcaggcggcucacgaggucaggaga

SEQ ID NO: 138550 - RNA, 22 nt, Human
uauacaaacaauuucaaaaaga

SEQ ID NO: 138551 - RNA, 27 nt, Human
aggcuaaaggcggccagguuugcagug

SEQ ID NO: 138552 - RNA, 26 nt, Human
aagucuucucuuugcuugcugaucuc

SEQ ID NO: 138553 - RNA, 22 nt, Human
uacagcccuggugggggagaag

SEQ ID NO: 138554 - RNA, 21 nt, Human
ccaccaacaguguauaggugu

SEQ ID NO: 138555 - RNA, 20 nt, Human
agauaaauauuugacuugca

SEQ ID NO: 138556 - RNA, 20 nt, Human
gccgccucgcuccucuucag

SEQ ID NO: 138557 - RNA, 21 nt, Human
aagugcugggaugacaggugu

SEQ ID NO: 138558 - RNA, 24 nt, Human
uggacucaaacugccuuggcuuca

SEQ ID NO: 138559 - RNA, 18 nt, Human
agaaggcagacuggguga

SEQ ID NO: 138560 - RNA, 25 nt, Human
agcaccuucagggcugaguucuggg

SEQ ID NO: 138561 - RNA, 26 nt, Human
cugccucucccacuaggucuggaugg

SEQ ID NO: 138562 - RNA, 21 nt, Human
gucgccaggcuagagugcggu

SEQ ID NO: 138563 - RNA, 26 nt, Human
gaauucuccuuugagauuucagaaga

SEQ ID NO: 138564 - RNA, 19 nt, Human
ugcccugugguugcaccug

SEQ ID NO: 138565 - RNA, 22 nt, Human
ccucaucugcaccauguccccg

SEQ ID NO: 138566 - RNA, 24 nt, Human
ggagcacagagcacggaguggacu

SEQ ID NO: 138567 - RNA, 22 nt, Human
ugcacaucuuguaaaauuggac

SEQ ID NO: 138568 - RNA, 25 nt, Human
gacagauuuaaagcacaugccuucu

SEQ ID NO: 138569 - RNA, 23 nt, Human
ucagcagacaacaagcaauucua

SEQ ID NO: 138570 - RNA, 28 nt, Human
cuacccaagccgccuccagguacagcca

SEQ ID NO: 138571 - RNA, 27 nt, Human
ugaccaacacaugugagacccaguccu

SEQ ID NO: 138572 - RNA, 22 nt, Human
caacauaguaagaccccaucuc

SEQ ID NO: 138573 - RNA, 27 nt, Human
cucucuucuugcuuggcagcuggacca

SEQ ID NO: 138574 - RNA, 21 nt, Human
aaucagaaagaagcaaaagga

SEQ ID NO: 138575 - RNA, 24 nt, Human
gacuguaaguuccuugggggcagg

SEQ ID NO: 138576 - RNA, 27 nt, Human
gccagccccgacugcuccuccucuucc

SEQ ID NO: 138577 - RNA, 25 nt, Human
uugcaaccuuuccuucugcuagggu

SEQ ID NO: 138578 - RNA, 25 nt, Human
gauucagagaggcgugagcagcccc

SEQ ID NO: 138579 - RNA, 22 nt, Human
cacaugcuuacugguggccuca

SEQ ID NO: 138580 - RNA, 27 nt, Human
ccgugcuggacaucagaaaugcagugg

SEQ ID NO: 138581 - RNA, 22 nt, Human
ccaccgcgccuggccuauacca

SEQ ID NO: 138582 - RNA, 21 nt, Human
ccgcguagcuggcauacaggu

SEQ ID NO: 138583 - RNA, 25 nt, Human
cucuccugugugcuugucagugggg

SEQ ID NO: 138584 - RNA, 29 nt, Human
uacagguguaagccaucacaccuggcccu

SEQ ID NO: 138585 - RNA, 27 nt, Human
caaaccugaggccucccggcagaccca

SEQ ID NO: 138586 - RNA, 21 nt, Human
agucuucucuccacuucugga

SEQ ID NO: 138587 - RNA, 22 nt, Human
acucaggcuggaauguagugga

SEQ ID NO: 138588 - RNA, 26 nt, Human
ccagcugucugcuggguucuuuucuc

SEQ ID NO: 138589 - RNA, 29 nt, Human
uucccugugaucucaaaacaauuguugca

SEQ ID NO: 138590 - RNA, 23 nt, Human
gggacagagcaggugcagaggca

SEQ ID NO: 138591 - RNA, 23 nt, Human
uggaacucuuuauuuaaauaugu

SEQ ID NO: 138592 - RNA, 27 nt, Human
auucuaucggccaggcuggagugcagu

SEQ ID NO: 138593 - RNA, 22 nt, Human
ugagugccaagucagagcugug

SEQ ID NO: 138594 - RNA, 27 nt, Human
gcugggguuccaggcaugguuuaggcc

SEQ ID NO: 138595 - RNA, 26 nt, Human
uccccucuuggcagggugggcaugag

SEQ ID NO: 138596 - RNA, 30 nt, Human
caccuuuucagguuggagugcauucauuca

SEQ ID NO: 138597 - RNA, 27 nt, Human
agcucacugggagcaaugggguugcag

SEQ ID NO: 138598 - RNA, 23 nt, Human
cccuugggcuuccugccuugcag

SEQ ID NO: 138599 - RNA, 26 nt, Human
acuuuguguugaccucaucccuggcu

SEQ ID NO: 138600 - RNA, 19 nt, Human
ucccacgcuuccucucucu

SEQ ID NO: 138601 - RNA, 26 nt, Human
gguggaggcagccagggcuuaccugu

SEQ ID NO: 138602 - RNA, 22 nt, Human
ccugugcaaagguguauugugg

SEQ ID NO: 138603 - RNA, 20 nt, Human
aggaggacaaauuugcaaaa

SEQ ID NO: 138604 - RNA, 23 nt, Human
caggcuucuuaguggaaacugca

SEQ ID NO: 138605 - RNA, 22 nt, Human
cugccuccuggguucaagugau

SEQ ID NO: 138606 - RNA, 21 nt, Human
ugagcagagucuugcuaccuc

SEQ ID NO: 138607 - RNA, 22 nt, Human
agaccuacagaccuggcucuca

SEQ ID NO: 138608 - RNA, 26 nt, Human
accaugguaugcaugaucguuguaau

SEQ ID NO: 138609 - RNA, 25 nt, Human
uuguacagaguacgagaggacagca

SEQ ID NO: 138610 - RNA, 22 nt, Human
cuuacuuccuggccucuucugg

SEQ ID NO: 138611 - RNA, 21 nt, Human
auagaaauuugggguucuaaa

SEQ ID NO: 138612 - RNA, 25 nt, Human
ccgaagagacccaggaaggauucuu

SEQ ID NO: 138613 - RNA, 20 nt, Human
cuugugagauccuucacagg

SEQ ID NO: 138614 - RNA, 18 nt, Human
cagccuccugccugcucc

SEQ ID NO: 138615 - RNA, 20 nt, Human
uguuuuccuuucuuccuucu

SEQ ID NO: 138616 - RNA, 21 nt, Human
gcgugagccaccagccaggcc

SEQ ID NO: 138617 - RNA, 28 nt, Human
accugaugccaguacagugcaauuggaa

SEQ ID NO: 138618 - RNA, 18 nt, Human
gaugcucuucuguggacc

SEQ ID NO: 138619 - RNA, 27 nt, Human
uccugcagggccacagucggcacuguu

SEQ ID NO: 138620 - RNA, 22 nt, Human
gcuauaaaagcaccaaaaagaa

SEQ ID NO: 138621 - RNA, 20 nt, Human
ucuugaguuccugaauuuug

SEQ ID NO: 138622 - RNA, 24 nt, Human
cagagcccugcccugcacccuugu

SEQ ID NO: 138623 - RNA, 26 nt, Human
ccuccccaggcugaaguguccucagg

SEQ ID NO: 138624 - RNA, 20 nt, Human
ccuuucugcccuccugcucc

SEQ ID NO: 138625 - RNA, 26 nt, Human
ccacugcacuugccaccugagucaca

SEQ ID NO: 138626 - RNA, 22 nt, Human
gagcagcaggaggcugaaggag

SEQ ID NO: 138627 - RNA, 21 nt, Human
uggugaagagaaaaaggcuga

SEQ ID NO: 138628 - RNA, 22 nt, Human
uucuucuucuucuaaaauauug

SEQ ID NO: 138629 - RNA, 24 nt, Human
uucaaggcaaguaaaugaauggaa

SEQ ID NO: 138630 - RNA, 26 nt, Human
ugcuuuccacuccaauucacacaggc

SEQ ID NO: 138631 - RNA, 32 nt, Human
uccuagagggagauuguuagaucaugaaacua

SEQ ID NO: 138632 - RNA, 21 nt, Human
ucacccugaccgccucccucc

SEQ ID NO: 138633 - RNA, 27 nt, Human
gaaaugaggccauggacucuguccuga

SEQ ID NO: 138634 - RNA, 21 nt, Human
cccccagugggaccacaugcc

SEQ ID NO: 138635 - RNA, 22 nt, Human
ucaguauuaccaugucucccuc

SEQ ID NO: 138636 - RNA, 20 nt, Human
uauggggccaaucucuguga

SEQ ID NO: 138637 - RNA, 18 nt, Human
gaguuuccuaaaaguuca

SEQ ID NO: 138638 - RNA, 22 nt, Human
cucuuucccaggagcccugcca

SEQ ID NO: 138639 - RNA, 21 nt, Human
gagauguuugaauuuuucucu

SEQ ID NO: 138640 - RNA, 18 nt, Human
ggcacucuucccaccuca

SEQ ID NO: 138641 - RNA, 20 nt, Human
ccucuugcccagcugccucu

SEQ ID NO: 138642 - RNA, 23 nt, Human
uucagaacuuggguuucaauugu

SEQ ID NO: 138643 - RNA, 21 nt, Human
gaggagcagaggcauggagga

SEQ ID NO: 138644 - RNA, 23 nt, Human
uauuguccaggcuagagugcagu

SEQ ID NO: 138645 - RNA, 22 nt, Human
uguaggucggaggaauggaggc

SEQ ID NO: 138646 - RNA, 22 nt, Human
ccauuuccugaguucuuccuca

SEQ ID NO: 138647 - RNA, 27 nt, Human
ucaucaucuuacaucagacuuucuaac

SEQ ID NO: 138648 - RNA, 21 nt, Human
ugugugccaggggcugguggg

SEQ ID NO: 138649 - RNA, 24 nt, Human
ucucuaggaagacgcuuuauuccu

SEQ ID NO: 138650 - RNA, 23 nt, Human
cuccggucuggaauuucugagug

SEQ ID NO: 138651 - RNA, 21 nt, Human
gacaagcuucaucugcaguca

SEQ ID NO: 138652 - RNA, 22 nt, Human
cuccagggguaacuucaucucc

SEQ ID NO: 138653 - RNA, 20 nt, Human
ucgaaauuggacugucuuua

SEQ ID NO: 138654 - RNA, 22 nt, Human
agguguucauucacuugcauuu

SEQ ID NO: 138655 - RNA, 22 nt, Human
cuguaggaauggaagcuucagg

SEQ ID NO: 138656 - RNA, 27 nt, Human
ccugccuggaguucccccuggcucuag

SEQ ID NO: 138657 - RNA, 21 nt, Human
cauucccugagucaccaggaa

SEQ ID NO: 138658 - RNA, 27 nt, Human
cccucauuccuucccagagauguugag

SEQ ID NO: 138659 - RNA, 18 nt, Human
acucgggaaaccuggggc

SEQ ID NO: 138660 - RNA, 24 nt, Human
cucuuccuauccuguagcguguag

SEQ ID NO: 138661 - RNA, 19 nt, Human
cuccugcagggagccuucu

SEQ ID NO: 138662 - RNA, 22 nt, Human
acgccuguaauucuagcacuuu

SEQ ID NO: 138663 - RNA, 19 nt, Human
ucuuucuccauucuguucc

SEQ ID NO: 138664 - RNA, 30 nt, Human
uucuagucuuaacauacuugcauccacuuc

SEQ ID NO: 138665 - RNA, 20 nt, Human
augguggaaacaguggggaa

SEQ ID NO: 138666 - RNA, 27 nt, Human
gaccagccuggccaacaugguaaaacu

SEQ ID NO: 138667 - RNA, 22 nt, Human
accaagugucaccgcagcaaga

SEQ ID NO: 138668 - RNA, 22 nt, Human
guagcccaggcuggagugcaau

SEQ ID NO: 138669 - RNA, 27 nt, Human
gggagggcacaggcaagaagagauuca

SEQ ID NO: 138670 - RNA, 21 nt, Human
ugggagacacaacaaggggug

SEQ ID NO: 138671 - RNA, 23 nt, Human
cgcagugccaugcgcaggugcuu

SEQ ID NO: 138672 - RNA, 21 nt, Human
agcuccucacagaguaugugu

SEQ ID NO: 138673 - RNA, 24 nt, Human
cguccuuugguaaagggaagcugu

SEQ ID NO: 138674 - RNA, 26 nt, Human
agucacacaggacagaggaggcagag

SEQ ID NO: 138675 - RNA, 22 nt, Human
auggccuuuuaaauauuguaau

SEQ ID NO: 138676 - RNA, 21 nt, Human
uuucccaagcuggagugcagu

SEQ ID NO: 138677 - RNA, 25 nt, Human
ccaucaccacggcucacugcagccu

SEQ ID NO: 138678 - RNA, 24 nt, Human
aaaguccaggugacugcccuccuu

SEQ ID NO: 138679 - RNA, 22 nt, Human
ggcauggcaucuucaaaacaau

SEQ ID NO: 138680 - RNA, 16 nt, Human
cuucccuucugagucu

SEQ ID NO: 138681 - RNA, 19 nt, Human
cuaguuucuguucuguaaa

SEQ ID NO: 138682 - RNA, 19 nt, Human
gcaccuuucccugucgcuc

SEQ ID NO: 138683 - RNA, 20 nt, Human
aguuaagcauuaccuuucua

SEQ ID NO: 138684 - RNA, 22 nt, Human
caggcuggagugcauuggcgcg

SEQ ID NO: 138685 - RNA, 21 nt, Human
guuucugcuuuguagacaauu

SEQ ID NO: 138686 - RNA, 21 nt, Human
ucugggcacagagggguccac

SEQ ID NO: 138687 - RNA, 24 nt, Human
agccucuccuugccuggugaccua

SEQ ID NO: 138688 - RNA, 26 nt, Human
cccucgggggcugucagauuugugac

SEQ ID NO: 138689 - RNA, 22 nt, Human
uuuuuuccucuuccauacuggu

SEQ ID NO: 138690 - RNA, 21 nt, Human
guccucuccgcccugcggcca

SEQ ID NO: 138691 - RNA, 21 nt, Human
uaacugcagcaguucaccuau

SEQ ID NO: 138692 - RNA, 19 nt, Human
uauugucauuacugccuuu

SEQ ID NO: 138693 - RNA, 21 nt, Human
accacuguauguuuacuucuc

SEQ ID NO: 138694 - RNA, 25 nt, Human
ggucuucugugagcuacaggcacag

SEQ ID NO: 138695 - RNA, 24 nt, Human
ggugcucuggggcuggaggcuagu

SEQ ID NO: 138696 - RNA, 21 nt, Human
agggugcuggggugaccucau

SEQ ID NO: 138697 - RNA, 20 nt, Human
guucauuucagccucuggau

SEQ ID NO: 138698 - RNA, 20 nt, Human
uuugaugagcaaaugagcua

SEQ ID NO: 138699 - RNA, 20 nt, Human
ucuuccuuggccuauuccgg

SEQ ID NO: 138700 - RNA, 19 nt, Human
caggccgggagucacugga

SEQ ID NO: 138701 - RNA, 21 nt, Human
guccucgggguuccuucucac

SEQ ID NO: 138702 - RNA, 19 nt, Human
cacaaacaagcacauacac

SEQ ID NO: 138703 - RNA, 25 nt, Human
cagucuuccuucuguagagggcugu

SEQ ID NO: 138704 - RNA, 23 nt, Human
gcuugggaucagaagucagaagu

SEQ ID NO: 138705 - RNA, 21 nt, Human
aacuuaccugcuaggaaugcu

SEQ ID NO: 138706 - RNA, 22 nt, Human
cgaacuccugggcucaagcagu

SEQ ID NO: 138707 - RNA, 21 nt, Human
augcgcugcucaaccucucuc

SEQ ID NO: 138708 - RNA, 22 nt, Human
uucauucugucacuuggcuucg

SEQ ID NO: 138709 - RNA, 27 nt, Human
ucaggagguggagcucgucgucagcuc

SEQ ID NO: 138710 - RNA, 24 nt, Human
gcauagaggcuucuccgccagccu

SEQ ID NO: 138711 - RNA, 18 nt, Human
aucuaaguucauacuggu

SEQ ID NO: 138712 - RNA, 26 nt, Human
cggaggguggaagaggagagggugga

SEQ ID NO: 138713 - RNA, 21 nt, Human
cauuucugccugacugcucca

SEQ ID NO: 138714 - RNA, 29 nt, Human
aacucaaccaaaugguacuuuuccacagu

SEQ ID NO: 138715 - RNA, 22 nt, Human
ugcaccuccccaggcagaggga

SEQ ID NO: 138716 - RNA, 21 nt, Human
augcuuuuauaggccugugug

SEQ ID NO: 138717 - RNA, 21 nt, Human
cccagccuccagggcccgggc

SEQ ID NO: 138718 - RNA, 22 nt, Human
ugcucaaucucuguugcaccug

SEQ ID NO: 138719 - RNA, 24 nt, Human
gcuccuucccucggcucauggccc

SEQ ID NO: 138720 - RNA, 18 nt, Human
gguauuugagugugcaag

SEQ ID NO: 138721 - RNA, 25 nt, Human
cuuccuccugccccagcccaaccuc

SEQ ID NO: 138722 - RNA, 21 nt, Human
gggaaagagaaccacaauaga

SEQ ID NO: 138723 - RNA, 25 nt, Human
acaaaacaucaaguuccacacacgc

SEQ ID NO: 138724 - RNA, 22 nt, Human
augguuacucauuuuaucaggg

SEQ ID NO: 138725 - RNA, 24 nt, Human
uuccucugguucuugccugcuuca

SEQ ID NO: 138726 - RNA, 24 nt, Human
auguggagaaguacaaggaagcag

SEQ ID NO: 138727 - RNA, 24 nt, Human
ggauucuaugaaaaauucuugccu

SEQ ID NO: 138728 - RNA, 22 nt, Human
gcagucguggcucacugcagcc

SEQ ID NO: 138729 - RNA, 25 nt, Human
ucuccgcaccucuccagcuccugca

SEQ ID NO: 138730 - RNA, 24 nt, Human
gcuguacuuuugauagcugugcca

SEQ ID NO: 138731 - RNA, 24 nt, Human
cuguccccucucuccacacccagc

SEQ ID NO: 138732 - RNA, 21 nt, Human
gccacccaggugauguuagug

SEQ ID NO: 138733 - RNA, 25 nt, Human
ccuccagcaaguuuaaaaauaauua

SEQ ID NO: 138734 - RNA, 26 nt, Human
acugcacuguuaauaacucucagcag

SEQ ID NO: 138735 - RNA, 22 nt, Human
ggaaagcgggcgacccaccucc

SEQ ID NO: 138736 - RNA, 26 nt, Human
auuuuaugcugaaucugcauucuguc

SEQ ID NO: 138737 - RNA, 22 nt, Human
uugcccaggcuggucuugaagu

SEQ ID NO: 138738 - RNA, 23 nt, Human
uggagggagagcagagaccaugu

SEQ ID NO: 138739 - RNA, 22 nt, Human
augaagagaccucagacaucuu

SEQ ID NO: 138740 - RNA, 26 nt, Human
agaaaaugcuaguauguuuugcucac

SEQ ID NO: 138741 - RNA, 26 nt, Human
ccuccguguggacugugccucaggcc

SEQ ID NO: 138742 - RNA, 20 nt, Human
ucauaccuggcuugcaggga

SEQ ID NO: 138743 - RNA, 23 nt, Human
uucuccaagccuggucagcugcc

SEQ ID NO: 138744 - RNA, 22 nt, Human
acuucugauuuagauacuucuc

SEQ ID NO: 138745 - RNA, 17 nt, Human
acuguugcccgaggacu

SEQ ID NO: 138746 - RNA, 23 nt, Human
cugccgagccugcaucacuguga

SEQ ID NO: 138747 - RNA, 22 nt, Human
caaguucucagcaccuacuuuu

SEQ ID NO: 138748 - RNA, 26 nt, Human
agcucuuucuuuucugcuguuuccca

SEQ ID NO: 138749 - RNA, 19 nt, Human
cuucccugguaccuagcaa

SEQ ID NO: 138750 - RNA, 19 nt, Human
agucagcuuggaucauuca

SEQ ID NO: 138751 - RNA, 21 nt, Human
uggcuucauacucuuucuuug

SEQ ID NO: 138752 - RNA, 26 nt, Human
gaggaagauacauuuuagugguagca

SEQ ID NO: 138753 - RNA, 23 nt, Human
uuguuuugugucucuuauggaug

SEQ ID NO: 138754 - RNA, 23 nt, Human
ggaugaugaacuggaauaacgau

SEQ ID NO: 138755 - RNA, 20 nt, Human
ggauauauccugguguugcu

SEQ ID NO: 138756 - RNA, 20 nt, Human
gauuacauuguggacuuuga

SEQ ID NO: 138757 - RNA, 26 nt, Human
cucucaucuuuuucaagucuuuucca

SEQ ID NO: 138758 - RNA, 22 nt, Human
aggcugaggcuggagaaucgcu

SEQ ID NO: 138759 - RNA, 24 nt, Human
cacucucccucucugggcaugucu

SEQ ID NO: 138760 - RNA, 20 nt, Human
cacuccugcguuccugucca

SEQ ID NO: 138761 - RNA, 19 nt, Human
agcucggccaucacgucaa

SEQ ID NO: 138762 - RNA, 21 nt, Human
aaugugggaggguaguuucag

SEQ ID NO: 138763 - RNA, 25 nt, Human
uuggagcuccugacugcagggacuc

SEQ ID NO: 138764 - RNA, 22 nt, Human
uggcuuauucccaacugcucug

SEQ ID NO: 138765 - RNA, 19 nt, Human
ucaugaucugcugucugua

SEQ ID NO: 138766 - RNA, 26 nt, Human
gcagccuggccaacauggcaaaaccc

SEQ ID NO: 138767 - RNA, 22 nt, Human
uuccaauacuucauuaauuuca

SEQ ID NO: 138768 - RNA, 22 nt, Human
cuugagaauagagccacaaaaa

SEQ ID NO: 138769 - RNA, 27 nt, Human
acacagcccugcuucugacauaaucca

SEQ ID NO: 138770 - RNA, 22 nt, Human
uaccuguaaucccagcacuuug

SEQ ID NO: 138771 - RNA, 20 nt, Human
aaaguugccuuuucucucca

SEQ ID NO: 138772 - RNA, 27 nt, Human
gcggacccuggcagcgaugggucucca

SEQ ID NO: 138773 - RNA, 23 nt, Human
uucagaauucccauuuacauauu

SEQ ID NO: 138774 - RNA, 23 nt, Human
ugagaccaagagaaaggguguau

SEQ ID NO: 138775 - RNA, 23 nt, Human
gagcuagggcucugggggucugc

SEQ ID NO: 138776 - RNA, 22 nt, Human
agcaggccugagccccucucug

SEQ ID NO: 138777 - RNA, 22 nt, Human
gacuauguuagcaagugucacg

SEQ ID NO: 138778 - RNA, 18 nt, Human
gauuuuugugaagcaauu

SEQ ID NO: 138779 - RNA, 22 nt, Human
ucuguggcccaggcuggagugc

SEQ ID NO: 138780 - RNA, 21 nt, Human
cugccagucucuuguacucug

SEQ ID NO: 138781 - RNA, 27 nt, Human
caugaagggaaaauuagcuuuuaguuu

SEQ ID NO: 138782 - RNA, 20 nt, Human
aaccaaugcucuauauugcu

SEQ ID NO: 138783 - RNA, 20 nt, Human
uucacugaccaaccaaccaa

SEQ ID NO: 138784 - RNA, 18 nt, Human
gaaaccagaucuguuuag

SEQ ID NO: 138785 - RNA, 23 nt, Human
cuugcacuacugcacuccagccu

SEQ ID NO: 138786 - RNA, 23 nt, Human
cuguuggugcuggcccuugggga

SEQ ID NO: 138787 - RNA, 21 nt, Human
gguagaauaucagaguggggc

SEQ ID NO: 138788 - RNA, 21 nt, Human
uagucauaccuggaauguguc

SEQ ID NO: 138789 - RNA, 23 nt, Human
acauuccacaucguccucccuuu

SEQ ID NO: 138790 - RNA, 24 nt, Human
ggaaagggaagaucuuaugccuuu

SEQ ID NO: 138791 - RNA, 23 nt, Human
gcacugggcuggggcacagcccc

SEQ ID NO: 138792 - RNA, 21 nt, Human
uuuccccucauucauguggcu

SEQ ID NO: 138793 - RNA, 23 nt, Human
acucagcccugagcagggaacag

SEQ ID NO: 138794 - RNA, 23 nt, Human
aauuaaaaugagagaaaacucua

SEQ ID NO: 138795 - RNA, 28 nt, Human
uccagcaagaaagauugugaugcaagau

SEQ ID NO: 138796 - RNA, 22 nt, Human
gccucugcuggagugcagugag

SEQ ID NO: 138797 - RNA, 28 nt, Human
gcgugagacgccaccauuccuggaaacc

SEQ ID NO: 138798 - RNA, 21 nt, Human
ucucccacauauucacauacg

SEQ ID NO: 138799 - RNA, 22 nt, Human
cucauucuucuuuuauuauuca

SEQ ID NO: 138800 - RNA, 25 nt, Human
uuagaguacaaaacauguucucccu

SEQ ID NO: 138801 - RNA, 23 nt, Human
ucucucucaacuuccugcacuua

SEQ ID NO: 138802 - RNA, 23 nt, Human
ccuccugccugcaggaucaugcc

SEQ ID NO: 138803 - RNA, 20 nt, Human
ccuccugccucccugccucc

SEQ ID NO: 138804 - RNA, 20 nt, Human
cugucucuuccacuuggucu

SEQ ID NO: 138805 - RNA, 21 nt, Human
ggccguuuuuggcuuuuuugu

SEQ ID NO: 138806 - RNA, 21 nt, Human
ccucuucgcugaccucgaccc

SEQ ID NO: 138807 - RNA, 22 nt, Human
auccagaguuuagcccugggag

SEQ ID NO: 138808 - RNA, 23 nt, Human
gaccacgcuccuuccucgggaag

SEQ ID NO: 138809 - RNA, 26 nt, Human
cccagugccccuggcuaggggcagag

SEQ ID NO: 138810 - RNA, 27 nt, Human
cucuccaaacuaugccaaggcggcggc

SEQ ID NO: 138811 - RNA, 27 nt, Human
ccaaagguggagguugcaguaagcuga

SEQ ID NO: 138812 - RNA, 21 nt, Human
cccuggguccuucuagcuuuu

SEQ ID NO: 138813 - RNA, 25 nt, Human
ccuccucccuucuacugcuucuacc

SEQ ID NO: 138814 - RNA, 23 nt, Human
aaaauugacaguuaagagccaaa

SEQ ID NO: 138815 - RNA, 23 nt, Human
ucucuuccucuccaggccuugcc

SEQ ID NO: 138816 - RNA, 19 nt, Human
ccaugguguuucucucggg

SEQ ID NO: 138817 - RNA, 22 nt, Human
agcuguaaaggaccuccuaaau

SEQ ID NO: 138818 - RNA, 23 nt, Human
agcuuaucugaauuauuuuccaa

SEQ ID NO: 138819 - RNA, 20 nt, Human
auauauacuuauagaauuca

SEQ ID NO: 138820 - RNA, 20 nt, Human
gcuuuccguccgccagugca

SEQ ID NO: 138821 - RNA, 22 nt, Human
cuuauuuuauuuccaucauguc

SEQ ID NO: 138822 - RNA, 25 nt, Human
gccagcaacaugugccccagaucug

SEQ ID NO: 138823 - RNA, 27 nt, Human
ucgcgcaucuccagccuaaggguuguc

SEQ ID NO: 138824 - RNA, 26 nt, Human
ugagccaggaggucuagaacuggagc

SEQ ID NO: 138825 - RNA, 21 nt, Human
aagcagaugacagagguuuga

SEQ ID NO: 138826 - RNA, 20 nt, Human
gguuuugcaaccugaggucu

SEQ ID NO: 138827 - RNA, 26 nt, Human
gcagcccaguggaauggaaagaaugu

SEQ ID NO: 138828 - RNA, 24 nt, Human
gcccgaccuggggcugagugcaga

SEQ ID NO: 138829 - RNA, 22 nt, Human
ccugcgucgcuaagacugucau

SEQ ID NO: 138830 - RNA, 16 nt, Human
auggggcagggcuggg

SEQ ID NO: 138831 - RNA, 22 nt, Human
cacauccucuguucucuaccug

SEQ ID NO: 138832 - RNA, 21 nt, Human
aagaccccagagaugcuuaga

SEQ ID NO: 138833 - RNA, 24 nt, Human
acuguuucuacuccucccuccucc

SEQ ID NO: 138834 - RNA, 25 nt, Human
ugaaggaggagaacuugggagccag

SEQ ID NO: 138835 - RNA, 22 nt, Human
uucucuuuacauucagucuugg

SEQ ID NO: 138836 - RNA, 22 nt, Human
ccaggaggucgaggcugcagug

SEQ ID NO: 138837 - RNA, 22 nt, Human
gcucacaccuguaaucccagcg

SEQ ID NO: 138838 - RNA, 23 nt, Human
acacccuacaaguugaucaugca

SEQ ID NO: 138839 - RNA, 21 nt, Human
auguacaaggacugacuuuaa

SEQ ID NO: 138840 - RNA, 23 nt, Human
guucucugccgucuuuggcucag

SEQ ID NO: 138841 - RNA, 25 nt, Human
uaucucaaagucuuuuguacauaac

SEQ ID NO: 138842 - RNA, 22 nt, Human
cccugcuccagucgaguuggcc

SEQ ID NO: 138843 - RNA, 22 nt, Human
cacaugcucaucccaaaagcua

SEQ ID NO: 138844 - RNA, 20 nt, Human
ucuuuauugauuagcacuga

SEQ ID NO: 138845 - RNA, 19 nt, Human
ccacagccaucccagccuu

SEQ ID NO: 138846 - RNA, 19 nt, Human
uuaguggaagcaauuugua

SEQ ID NO: 138847 - RNA, 19 nt, Human
accccugaauucuucaaug

SEQ ID NO: 138848 - RNA, 20 nt, Human
agauuaaaaaccagugaucu

SEQ ID NO: 138849 - RNA, 22 nt, Human
guugugcuguggggaagggaga

SEQ ID NO: 138850 - RNA, 21 nt, Human
acauguguaacguuuugguug

SEQ ID NO: 138851 - RNA, 26 nt, Human
uggagaucuuaagauuccauuuugga

SEQ ID NO: 138852 - RNA, 23 nt, Human
uuguaaucacauggugacaacac

SEQ ID NO: 138853 - RNA, 20 nt, Human
cgcggcccccacgcugcagu

SEQ ID NO: 138854 - RNA, 22 nt, Human
ucaauaaaguguacuaccucuu

SEQ ID NO: 138855 - RNA, 23 nt, Human
uugccaggcugugguugugaguc

SEQ ID NO: 138856 - RNA, 22 nt, Human
cugaggcaguagaaucgcuuga

SEQ ID NO: 138857 - RNA, 27 nt, Human
ccagauuugagagagggaccuggccag

SEQ ID NO: 138858 - RNA, 20 nt, Human
auuccucugcugucccugcc

SEQ ID NO: 138859 - RNA, 21 nt, Human
auguaaacaaucagcucacag

SEQ ID NO: 138860 - RNA, 22 nt, Human
guuugucaucauccucaucuca

SEQ ID NO: 138861 - RNA, 27 nt, Human
ggaguuuuuaaaugccauuuguuucag

SEQ ID NO: 138862 - RNA, 21 nt, Human
uauaucccgaguggggcacag

SEQ ID NO: 138863 - RNA, 21 nt, Human
gccuccucccccuucccgacc

SEQ ID NO: 138864 - RNA, 23 nt, Human
cuugaugugaccgggaucccacu

SEQ ID NO: 138865 - RNA, 24 nt, Human
ccuggggcugguccugggagccac

SEQ ID NO: 138866 - RNA, 22 nt, Human
gaccacacccuguacuguucug

SEQ ID NO: 138867 - RNA, 27 nt, Human
ggagggaccacccucccugacuggccu

SEQ ID NO: 138868 - RNA, 21 nt, Human
agcuccugccugcagcuucca

SEQ ID NO: 138869 - RNA, 19 nt, Human
uucauaaggagucaauaug

SEQ ID NO: 138870 - RNA, 24 nt, Human
gggcugggcccacccaagcaggag

SEQ ID NO: 138871 - RNA, 20 nt, Human
ucccugagcccaccucccag

SEQ ID NO: 138872 - RNA, 23 nt, Human
guagcagcaccuacuaugcuuca

SEQ ID NO: 138873 - RNA, 26 nt, Human
ggccugcaugcugccugaucuugccu

SEQ ID NO: 138874 - RNA, 26 nt, Human
gcaguuaaaccaacacugacccccug

SEQ ID NO: 138875 - RNA, 22 nt, Human
aucccuugacuuuuguggccug

SEQ ID NO: 138876 - RNA, 23 nt, Human
acacaaacacauacacacaacac

SEQ ID NO: 138877 - RNA, 27 nt, Human
uaguccuucuuuaacuuagauauuuca

SEQ ID NO: 138878 - RNA, 25 nt, Human
cuccugugugccugccuccugccgc

SEQ ID NO: 138879 - RNA, 22 nt, Human
gguggagguggcggcggcagcg

SEQ ID NO: 138880 - RNA, 21 nt, Human
cuugaaaaacacuauuucugg

SEQ ID NO: 138881 - RNA, 27 nt, Human
ccagaaacuugucuucuaaaagggagg

SEQ ID NO: 138882 - RNA, 30 nt, Human
ccuggccacuggcccuguuucuccccacac

SEQ ID NO: 138883 - RNA, 28 nt, Human
aggcaccaaacacccacauaccuggccc

SEQ ID NO: 138884 - RNA, 25 nt, Human
uuuugccauguugaccaagcugguc

SEQ ID NO: 138885 - RNA, 29 nt, Human
cucuguaaaugccucucuagguagcugcu

SEQ ID NO: 138886 - RNA, 25 nt, Human
cucucagccucagugucccgagggc

SEQ ID NO: 138887 - RNA, 20 nt, Human
cugaaaacugugucuaugca

SEQ ID NO: 138888 - RNA, 22 nt, Human
gcaccagccaccaugccuggcu

SEQ ID NO: 138889 - RNA, 23 nt, Human
uccagagagcagggaacuaccuu

SEQ ID NO: 138890 - RNA, 21 nt, Human
uccccaccuggccuugcuggc

SEQ ID NO: 138891 - RNA, 22 nt, Human
cgggaggcagagguugcaguga

SEQ ID NO: 138892 - RNA, 22 nt, Human
ugggaggcagagguuguaguga

SEQ ID NO: 138893 - RNA, 20 nt, Human
gcugucucucccccucggcu

SEQ ID NO: 138894 - RNA, 26 nt, Human
ccucccggaaccuccccuuuggcuaa

SEQ ID NO: 138895 - RNA, 24 nt, Human
acagagcagggugcuauugugagg

SEQ ID NO: 138896 - RNA, 19 nt, Human
gcacucaguuuauucccua

SEQ ID NO: 138897 - RNA, 22 nt, Human
ugcaccuucacucuccagggua

SEQ ID NO: 138898 - RNA, 18 nt, Human
agccuccuaccuaaguca

SEQ ID NO: 138899 - RNA, 27 nt, Human
guugcccaggcuggagugcaaugacac

SEQ ID NO: 138900 - RNA, 24 nt, Human
gacagaggguauggaagacuugca

SEQ ID NO: 138901 - RNA, 22 nt, Human
gcuacagugagcugccauucca

SEQ ID NO: 138902 - RNA, 23 nt, Human
gcuccugauauuuuaucaugcuc

SEQ ID NO: 138903 - RNA, 29 nt, Human
uguccaaaaagggcuucaaggcccacuuc

SEQ ID NO: 138904 - RNA, 22 nt, Human
aucccuguccccgucagcagug

SEQ ID NO: 138905 - RNA, 24 nt, Human
cacuuucucaaagcacacuggaaa

SEQ ID NO: 138906 - RNA, 22 nt, Human
caggaguuugagggugaugugc

SEQ ID NO: 138907 - RNA, 23 nt, Human
agcacccugcaagccagccuggc

SEQ ID NO: 138908 - RNA, 20 nt, Human
cacaccguucguacgcccag

SEQ ID NO: 138909 - RNA, 24 nt, Human
agcuguuugcagaaaacugggugg

SEQ ID NO: 138910 - RNA, 21 nt, Human
aucagaggcaccuuguuuuca

SEQ ID NO: 138911 - RNA, 23 nt, Human
auacagaaaacuauuaucaguug

SEQ ID NO: 138912 - RNA, 22 nt, Human
guuaagacacaaggaaaaagaa

SEQ ID NO: 138913 - RNA, 24 nt, Human
uuguggcaccuuuucuuuuucucc

SEQ ID NO: 138914 - RNA, 21 nt, Human
gcuccugcauccucacugugg

SEQ ID NO: 138915 - RNA, 30 nt, Human
cuuccucuucuuccucuucuuuucacaggu

SEQ ID NO: 138916 - RNA, 21 nt, Human
uaacaguuaguaauggugcug

SEQ ID NO: 138917 - RNA, 20 nt, Human
agcaggagguucugggccuc

SEQ ID NO: 138918 - RNA, 22 nt, Human
acugaucacuauauuacaucau

SEQ ID NO: 138919 - RNA, 26 nt, Human
gaagagagguaucauugcuguggaaa

SEQ ID NO: 138920 - RNA, 19 nt, Human
ugguauugauguaaaauac

SEQ ID NO: 138921 - RNA, 18 nt, Human
cucucucugaaaaugaca

SEQ ID NO: 138922 - RNA, 21 nt, Human
uucaaaacaucauaaagauga

SEQ ID NO: 138923 - RNA, 24 nt, Human
gcugcaucccaccagccugagcaa

SEQ ID NO: 138924 - RNA, 21 nt, Human
gccuuucacugaauuuucuga

SEQ ID NO: 138925 - RNA, 19 nt, Human
uucaucaaaaggauuaaug

SEQ ID NO: 138926 - RNA, 24 nt, Human
auuauuuguacuaaacaauguuuu

SEQ ID NO: 138927 - RNA, 20 nt, Human
ccucacaucugugcuccgug

SEQ ID NO: 138928 - RNA, 23 nt, Human
ccucagccccagcgccccucggc

SEQ ID NO: 138929 - RNA, 18 nt, Human
cucuaaaagaaggugcca

SEQ ID NO: 138930 - RNA, 26 nt, Human
ggggcuuucuggagaggagggaugcu

SEQ ID NO: 138931 - RNA, 22 nt, Human
caagguguccuacagaaaaacc

SEQ ID NO: 138932 - RNA, 27 nt, Human
auugcuugaguccgggagcucaaggca

SEQ ID NO: 138933 - RNA, 21 nt, Human
guugaugaccaaucucuguga

SEQ ID NO: 138934 - RNA, 27 nt, Human
aaggucuuacuccagcccuuccugggu

SEQ ID NO: 138935 - RNA, 21 nt, Human
cuucuaguuuuagauaacucc

SEQ ID NO: 138936 - RNA, 25 nt, Human
agaugccuccauucgccuguggacc

SEQ ID NO: 138937 - RNA, 27 nt, Human
uucugcacagucccuccaggguuuggg

SEQ ID NO: 138938 - RNA, 22 nt, Human
gcccuguaaagccaaacccccu

SEQ ID NO: 138939 - RNA, 21 nt, Human
caguucugcccaggcccggcu

SEQ ID NO: 138940 - RNA, 23 nt, Human
ccucuucuuccucuucuuuucac

SEQ ID NO: 138941 - RNA, 22 nt, Human
gaggaacucacauaccccaaau

SEQ ID NO: 138942 - RNA, 27 nt, Human
uuccaaaacauguguuuauuuccacau

SEQ ID NO: 138943 - RNA, 19 nt, Human
acauguggacucaccugag

SEQ ID NO: 138944 - RNA, 21 nt, Human
gcucaggccacacagagacac

SEQ ID NO: 138945 - RNA, 21 nt, Human
ugagaucaagugaauuggccc

SEQ ID NO: 138946 - RNA, 20 nt, Human
cuuccucccuuccuuucaca

SEQ ID NO: 138947 - RNA, 23 nt, Human
gaagcccaagaaaaugacugaag

SEQ ID NO: 138948 - RNA, 27 nt, Human
aagacuugcuucccggccacgcgcgcu

SEQ ID NO: 138949 - RNA, 27 nt, Human
aaucugucugauucuaugccuguauuu

SEQ ID NO: 138950 - RNA, 22 nt, Human
cauuccccauccugcaccggca

SEQ ID NO: 138951 - RNA, 20 nt, Human
ucuccacuggccaucuuguc

SEQ ID NO: 138952 - RNA, 21 nt, Human
ccuggugcucgggaagggagg

SEQ ID NO: 138953 - RNA, 23 nt, Human
ccccuguggagcccgcaccccca

SEQ ID NO: 138954 - RNA, 27 nt, Human
ccccacccacccuugggggagcaugau

SEQ ID NO: 138955 - RNA, 26 nt, Human
ucugucacacaggcuggagugcagug

SEQ ID NO: 138956 - RNA, 27 nt, Human
ucaugcugcaguggguaguucuaagga

SEQ ID NO: 138957 - RNA, 21 nt, Human
ggacaccaucgagggagcagg

SEQ ID NO: 138958 - RNA, 22 nt, Human
uucucauagcacgugugugauu

SEQ ID NO: 138959 - RNA, 25 nt, Human
cuggacacaccugcccuagcccuca

SEQ ID NO: 138960 - RNA, 23 nt, Human
agcucacuguaaccucaaacucu

SEQ ID NO: 138961 - RNA, 23 nt, Human
uuucacuguggugggauggugcc

SEQ ID NO: 138962 - RNA, 20 nt, Human
cccugggccaccuccuccag

SEQ ID NO: 138963 - RNA, 20 nt, Human
cccuggcaugaccauccugu

SEQ ID NO: 138964 - RNA, 25 nt, Human
gggcagcagcagcccugccccacac

SEQ ID NO: 138965 - RNA, 23 nt, Human
cuguucucaggauggagagaaca

SEQ ID NO: 138966 - RNA, 20 nt, Human
agcuggagugcaguggugcg

SEQ ID NO: 138967 - RNA, 26 nt, Human
gagagcuguggacucaggacccagga

SEQ ID NO: 138968 - RNA, 23 nt, Human
auagacaaauaauuuucccaaug

SEQ ID NO: 138969 - RNA, 20 nt, Human
ccaaacaagcucacuguguu

SEQ ID NO: 138970 - RNA, 22 nt, Human
uucaaaggauaugcagaaagau

SEQ ID NO: 138971 - RNA, 31 nt, Human
aguuccaguucccaugguguaugugguuuuu

SEQ ID NO: 138972 - RNA, 27 nt, Human
agcucacuuuguaccccucaccucugc

SEQ ID NO: 138973 - RNA, 26 nt, Human
agucagaaaugauucuaauuuaaaca

SEQ ID NO: 138974 - RNA, 18 nt, Human
caaggcagaggaggagga

SEQ ID NO: 138975 - RNA, 29 nt, Human
acagguguaagccaucacaccuggcccua

SEQ ID NO: 138976 - RNA, 24 nt, Human
ggccauaagcaucuucuggacagg

SEQ ID NO: 138977 - RNA, 21 nt, Human
uuucugaggcucgcuggugac

SEQ ID NO: 138978 - RNA, 19 nt, Human
uaagucuaucuuaacucug

SEQ ID NO: 138979 - RNA, 22 nt, Human
aguggcaugaucucggcuuacu

SEQ ID NO: 138980 - RNA, 25 nt, Human
gccuaacguauuuaauggaggaauc

SEQ ID NO: 138981 - RNA, 25 nt, Human
ucacaacaggcuggaugggugggug

SEQ ID NO: 138982 - RNA, 21 nt, Human
aaacauggagugaaagccauu

SEQ ID NO: 138983 - RNA, 21 nt, Human
gcugcccaggcuggaguacag

SEQ ID NO: 138984 - RNA, 20 nt, Human
ccuaucuggggacaggcugg

SEQ ID NO: 138985 - RNA, 21 nt, Human
ucauccacuuggagugcugcg

SEQ ID NO: 138986 - RNA, 27 nt, Human
uccuccuggccucccagguuucaguug

SEQ ID NO: 138987 - RNA, 26 nt, Human
cugccucugggcagccugcuuuggcc

SEQ ID NO: 138988 - RNA, 24 nt, Human
gggaccccaugauucagccacgga

SEQ ID NO: 138989 - RNA, 23 nt, Human
accucccaucccugcccuccucc

SEQ ID NO: 138990 - RNA, 27 nt, Human
agcucacugcuuuggcccccuuacucu

SEQ ID NO: 138991 - RNA, 22 nt, Human
uggagcuggagaguaaggcugu

SEQ ID NO: 138992 - RNA, 25 nt, Human
ggccucaagggauccucccaccucg

SEQ ID NO: 138993 - RNA, 26 nt, Human
cucuucuggaaacaaagggcucaagc

SEQ ID NO: 138994 - RNA, 22 nt, Human
cgcucugcucccugccuuugcc

SEQ ID NO: 138995 - RNA, 28 nt, Human
acaaccaccugucccugccucaguuccc

SEQ ID NO: 138996 - RNA, 21 nt, Human
aauacuggucaucuaacuuug

SEQ ID NO: 138997 - RNA, 24 nt, Human
cgcugggaacuggagcuggaguga

SEQ ID NO: 138998 - RNA, 22 nt, Human
gucccauucuccuaaggacuuu

SEQ ID NO: 138999 - RNA, 19 nt, Human
ugcagccaggcugggcaga

SEQ ID NO: 139000 - RNA, 19 nt, Human
cccucucuccccaguauua

SEQ ID NO: 139001 - RNA, 22 nt, Human
acugguucuuuuuaaagggaug

SEQ ID NO: 139002 - RNA, 23 nt, Human
cgaguagcuggaauuacaggcag

SEQ ID NO: 139003 - RNA, 24 nt, Human
ugccuguccuucuacucagcuguu

SEQ ID NO: 139004 - RNA, 29 nt, Human
gugcauacucuggucauuuuucaagccau

SEQ ID NO: 139005 - RNA, 25 nt, Human
gucucagccucuccccgccgccccc

SEQ ID NO: 139006 - RNA, 22 nt, Human
ugggccuaaauaaaugagcugu

SEQ ID NO: 139007 - RNA, 25 nt, Human
cccacauuucuguccucugcgcgug

SEQ ID NO: 139008 - RNA, 24 nt, Human
uuuccaacucuccccauuuuccug

SEQ ID NO: 139009 - RNA, 25 nt, Human
agcaugugggggaaggccuugcugu

SEQ ID NO: 139010 - RNA, 20 nt, Human
gaggaggaagcucacuggug

SEQ ID NO: 139011 - RNA, 23 nt, Human
gcuccguuuggcagugcaauggu

SEQ ID NO: 139012 - RNA, 21 nt, Human
ugaaacucuuuagacuuucug

SEQ ID NO: 139013 - RNA, 25 nt, Human
aggccuccccucuccugccucccuc

SEQ ID NO: 139014 - RNA, 20 nt, Human
caccuugccgcuuuucauca

SEQ ID NO: 139015 - RNA, 22 nt, Human
cuucugcagcccuccuucuggg

SEQ ID NO: 139016 - RNA, 21 nt, Human
uguuaaaaugaacuguugcua

SEQ ID NO: 139017 - RNA, 29 nt, Human
uuuugggcaauagagaugccuuccccugu

SEQ ID NO: 139018 - RNA, 27 nt, Human
cccagcacuucuggaacugugcuucuc

SEQ ID NO: 139019 - RNA, 27 nt, Human
uuaaaaaauauauuccuacagugaugu

SEQ ID NO: 139020 - RNA, 23 nt, Human
acucagagaccucagcuccagca

SEQ ID NO: 139021 - RNA, 27 nt, Human
uucuccugguagagggccggcuguauc

SEQ ID NO: 139022 - RNA, 21 nt, Human
aaccuuuuaaucuguguuucu

SEQ ID NO: 139023 - RNA, 20 nt, Human
ccuccuccuccucagccggc

SEQ ID NO: 139024 - RNA, 23 nt, Human
aagagccuguggucaggaaauca

SEQ ID NO: 139025 - RNA, 22 nt, Human
uuuggugucuuucucuuuuaga

SEQ ID NO: 139026 - RNA, 19 nt, Human
ugugauaccaaggagacca

SEQ ID NO: 139027 - RNA, 24 nt, Human
aggacccucuacacacagacagcu

SEQ ID NO: 139028 - RNA, 21 nt, Human
auccuuccccaccaucuucag

SEQ ID NO: 139029 - RNA, 24 nt, Human
guuuuuaaaauaucuuuugaccug

SEQ ID NO: 139030 - RNA, 19 nt, Human
ucaaguugacaacagcaga

SEQ ID NO: 139031 - RNA, 19 nt, Human
ugcuucuucucaaagcacu

SEQ ID NO: 139032 - RNA, 23 nt, Human
ugccuguagucccagcuacucag

SEQ ID NO: 139033 - RNA, 24 nt, Human
uucuugcuuucaaauaugcuaugg

SEQ ID NO: 139034 - RNA, 25 nt, Human
cacucacucgcuccucucucaccuc

SEQ ID NO: 139035 - RNA, 21 nt, Human
uucauuuuaacacuuguccug

SEQ ID NO: 139036 - RNA, 24 nt, Human
ugaucuccugauuagagagggugg

SEQ ID NO: 139037 - RNA, 20 nt, Human
ugcaacaacaaucaugcuua

SEQ ID NO: 139038 - RNA, 21 nt, Human
agaaagggaucugggagcgag

SEQ ID NO: 139039 - RNA, 20 nt, Human
cagguccuuucucagccucc

SEQ ID NO: 139040 - RNA, 26 nt, Human
uauugagcaucuucuacauccuaggc

SEQ ID NO: 139041 - RNA, 20 nt, Human
uccagcuagccaacuccucc

SEQ ID NO: 139042 - RNA, 26 nt, Human
uucucucuugauccuacaaacagaca

SEQ ID NO: 139043 - RNA, 27 nt, Human
gagcucuagacccuuacucagugccuu

SEQ ID NO: 139044 - RNA, 19 nt, Human
ugaccuaguuggugcagug

SEQ ID NO: 139045 - RNA, 18 nt, Human
uaccugguggcuuuuucu

SEQ ID NO: 139046 - RNA, 23 nt, Human
gggaaagaagagagccuuguugg

SEQ ID NO: 139047 - RNA, 20 nt, Human
uucaugagcaguuguagcag

SEQ ID NO: 139048 - RNA, 23 nt, Human
ucaggacucagaagccucugggu

SEQ ID NO: 139049 - RNA, 27 nt, Human
gagcacaccugcuuugccuugcugccu

SEQ ID NO: 139050 - RNA, 19 nt, Human
gacagcccugcucccugca

SEQ ID NO: 139051 - RNA, 21 nt, Human
cuucccuuugauuuuuugcug

SEQ ID NO: 139052 - RNA, 19 nt, Human
cugcucacccacagacaca

SEQ ID NO: 139053 - RNA, 27 nt, Human
accuguccagaagccuggccuaggcag

SEQ ID NO: 139054 - RNA, 22 nt, Human
cccugucuucccucuggagcug

SEQ ID NO: 139055 - RNA, 23 nt, Human
ccucaguucccagcuccccccgc

SEQ ID NO: 139056 - RNA, 22 nt, Human
cacuuaccgauccagagccucc

SEQ ID NO: 139057 - RNA, 22 nt, Human
ugccuauaaucuuagcacuuug

SEQ ID NO: 139058 - RNA, 21 nt, Human
ucucaagcuuuugaaugggug

SEQ ID NO: 139059 - RNA, 23 nt, Human
uaccacuaaacuguugugcaugg

SEQ ID NO: 139060 - RNA, 23 nt, Human
uccccaggcucuagugcaggagg

SEQ ID NO: 139061 - RNA, 22 nt, Human
uauuccuuucccuuccucuucg

SEQ ID NO: 139062 - RNA, 21 nt, Human
ggcucuuggaaauugagcgga

SEQ ID NO: 139063 - RNA, 21 nt, Human
gucuuuagcuaaugaauugcc

SEQ ID NO: 139064 - RNA, 21 nt, Human
aggaagcugccugguguggag

SEQ ID NO: 139065 - RNA, 22 nt, Human
guauuuuuguuacaaagccacu

SEQ ID NO: 139066 - RNA, 22 nt, Human
aaacgaucauuugugaccucag

SEQ ID NO: 139067 - RNA, 24 nt, Human
aagauugugauuagacacauuuac

SEQ ID NO: 139068 - RNA, 23 nt, Human
uaguagcugaauuugauucucca

SEQ ID NO: 139069 - RNA, 20 nt, Human
ccucauugcaaccuccgccu

SEQ ID NO: 139070 - RNA, 20 nt, Human
gcagccgccgccguccccgg

SEQ ID NO: 139071 - RNA, 20 nt, Human
uuauuuguaaaugucugacu

SEQ ID NO: 139072 - RNA, 23 nt, Human
aguccauuuucacacugcugaga

SEQ ID NO: 139073 - RNA, 26 nt, Human
acccaugaguucagaaggcacacucu

SEQ ID NO: 139074 - RNA, 22 nt, Human
ugccuauggggaguuacuccaa

SEQ ID NO: 139075 - RNA, 27 nt, Human
ucuuccuccagggacucuggggcccuu

SEQ ID NO: 139076 - RNA, 28 nt, Human
accauuuuuaaaguagaagaggguuuua

SEQ ID NO: 139077 - RNA, 22 nt, Human
caggccugaaacauuucuuuuc

SEQ ID NO: 139078 - RNA, 21 nt, Human
gcuucucagaacaugaaauca

SEQ ID NO: 139079 - RNA, 18 nt, Human
auacuauaucacuauuca

SEQ ID NO: 139080 - RNA, 22 nt, Human
cuuguaauaaauacugcagcuu

SEQ ID NO: 139081 - RNA, 25 nt, Human
augggaaagggugaggacuucacaa

SEQ ID NO: 139082 - RNA, 28 nt, Human
ggugaccuucugggaaauggcuugaagc

SEQ ID NO: 139083 - RNA, 19 nt, Human
gugucaguaguaggcucca

SEQ ID NO: 139084 - RNA, 23 nt, Human
gcugaguuccggggugcaauggg

SEQ ID NO: 139085 - RNA, 22 nt, Human
gccuauaaucccagugcuuugg

SEQ ID NO: 139086 - RNA, 26 nt, Human
ccucaaggacuuuucugcuauuuacu

SEQ ID NO: 139087 - RNA, 22 nt, Human
aagcgccaguacccagagacca

SEQ ID NO: 139088 - RNA, 20 nt, Human
ugugauucaagauauuuaca

SEQ ID NO: 139089 - RNA, 21 nt, Human
aagagccuauucaauagcuca

SEQ ID NO: 139090 - RNA, 28 nt, Human
uaucuaaggauuuagaccagaggucuag

SEQ ID NO: 139091 - RNA, 31 nt, Human
gggaugacgaggcgagagggaagcccuugcu

SEQ ID NO: 139092 - RNA, 22 nt, Human
uaccagacuuuacuuuguacuc

SEQ ID NO: 139093 - RNA, 20 nt, Human
gcagccgccuucuaguuggg

SEQ ID NO: 139094 - RNA, 25 nt, Human
cuguuuugagaggaggagggaagag

SEQ ID NO: 139095 - RNA, 21 nt, Human
ggauaauugcuucacagccuu

SEQ ID NO: 139096 - RNA, 25 nt, Human
agaacaaugguuuuuaaaagacuua

SEQ ID NO: 139097 - RNA, 22 nt, Human
cuacaaauguggaaagcucauu

SEQ ID NO: 139098 - RNA, 27 nt, Human
uaugggagucacuauuuauuauugcuu

SEQ ID NO: 139099 - RNA, 24 nt, Human
guggccaagggcuccagggccagg

SEQ ID NO: 139100 - RNA, 21 nt, Human
gcucacugcccccacgccucc

SEQ ID NO: 139101 - RNA, 22 nt, Human
caggcuggaguggaguggcgug

SEQ ID NO: 139102 - RNA, 27 nt, Human
guuugugagagcccagucauuguacug

SEQ ID NO: 139103 - RNA, 21 nt, Human
aauuauacugaacccauccaa

SEQ ID NO: 139104 - RNA, 22 nt, Human
accucugcuuuccuccacugcc

SEQ ID NO: 139105 - RNA, 23 nt, Human
ggggcucagggccagugcucacu

SEQ ID NO: 139106 - RNA, 23 nt, Human
uugaaaguccugcccugccuucc

SEQ ID NO: 139107 - RNA, 27 nt, Human
caggcuggaguggaguggcaugaucuc

SEQ ID NO: 139108 - RNA, 27 nt, Human
ugagaugagaggggagagcugaacaga

SEQ ID NO: 139109 - RNA, 22 nt, Human
auggugagcacgugaccaugcc

SEQ ID NO: 139110 - RNA, 17 nt, Human
auggugacaaugccuug

SEQ ID NO: 139111 - RNA, 26 nt, Human
cccgcuugucccgugcccuugugacc

SEQ ID NO: 139112 - RNA, 24 nt, Human
agugaacacuagccagacacucug

SEQ ID NO: 139113 - RNA, 26 nt, Human
uuuaucuauagggaaauacacguaau

SEQ ID NO: 139114 - RNA, 26 nt, Human
acagagcagaagacagaaccuggucu

SEQ ID NO: 139115 - RNA, 26 nt, Human
gggaguccacggagaagaugcaguga

SEQ ID NO: 139116 - RNA, 23 nt, Human
gucuccccagugggggauaaguc

SEQ ID NO: 139117 - RNA, 25 nt, Human
gggcggagacauggccaacaucgcg

SEQ ID NO: 139118 - RNA, 23 nt, Human
acggcacagagcauccgucuccc

SEQ ID NO: 139119 - RNA, 25 nt, Human
cugucucucuaggaauagggucugu

SEQ ID NO: 139120 - RNA, 32 nt, Human
guccgagaucggggguuggagugcgggugggc

SEQ ID NO: 139121 - RNA, 24 nt, Human
acuugcccaaggucagagccacuu

SEQ ID NO: 139122 - RNA, 21 nt, Human
cgcccgcagccaggggagcag

SEQ ID NO: 139123 - RNA, 22 nt, Human
aacuguacaguuacuuugaccu

SEQ ID NO: 139124 - RNA, 22 nt, Human
cucucaucaucauguucuuuua

SEQ ID NO: 139125 - RNA, 22 nt, Human
ugcugagcuagugaguggugca

SEQ ID NO: 139126 - RNA, 22 nt, Human
ucucucccucccuacugaggcc

SEQ ID NO: 139127 - RNA, 21 nt, Human
ugggaggaucaccugauguca

SEQ ID NO: 139128 - RNA, 27 nt, Human
caaaacaauuuauaccuuguguccuua

SEQ ID NO: 139129 - RNA, 22 nt, Human
accauaaagcuuggagugccuu

SEQ ID NO: 139130 - RNA, 17 nt, Human
cuucccuucguuugcau

SEQ ID NO: 139131 - RNA, 23 nt, Human
aaaaucuggcuucuaacuuucug

SEQ ID NO: 139132 - RNA, 22 nt, Human
ucacccagacuagaggucagug

SEQ ID NO: 139133 - RNA, 19 nt, Human
ccauacagaacaaaugaga

SEQ ID NO: 139134 - RNA, 22 nt, Human
cucaucucaucuccuacaccgu

SEQ ID NO: 139135 - RNA, 21 nt, Human
gggaagccuccgggugauagg

SEQ ID NO: 139136 - RNA, 27 nt, Human
guggggaggggacccaugaauccugac

SEQ ID NO: 139137 - RNA, 20 nt, Human
gagagcugagggaggcgcga

SEQ ID NO: 139138 - RNA, 22 nt, Human
accauccuggcgaacaugguga

SEQ ID NO: 139139 - RNA, 24 nt, Human
cgucugugccagcucaaauccagc

SEQ ID NO: 139140 - RNA, 18 nt, Human
ucucuuguccucuuccca

SEQ ID NO: 139141 - RNA, 27 nt, Human
cugggacugaagggaagcagagaucau

SEQ ID NO: 139142 - RNA, 27 nt, Human
gcacgggccuggcuggcacccgguuua

SEQ ID NO: 139143 - RNA, 18 nt, Human
ccaguuucagaguucuca

SEQ ID NO: 139144 - RNA, 26 nt, Human
uugugguuucaaaaucucuggcacca

SEQ ID NO: 139145 - RNA, 20 nt, Human
ggcauuuugucuccagggcu

SEQ ID NO: 139146 - RNA, 27 nt, Human
ugucagcaccuggaaguggagugcagg

SEQ ID NO: 139147 - RNA, 22 nt, Human
aucuauuucugucugcacuaga

SEQ ID NO: 139148 - RNA, 22 nt, Human
gccucccaaguaacugggauua

SEQ ID NO: 139149 - RNA, 28 nt, Human
uccaggguuuuuauccuggcugucuaug

SEQ ID NO: 139150 - RNA, 23 nt, Human
aguacucaguaaggcagugcagu

SEQ ID NO: 139151 - RNA, 21 nt, Human
uguguucccugucucagguca

SEQ ID NO: 139152 - RNA, 22 nt, Human
ccagcgggugggcaucuucccc

SEQ ID NO: 139153 - RNA, 22 nt, Human
acuuuucucccaauucugcgcu

SEQ ID NO: 139154 - RNA, 22 nt, Human
uuauguauaaaaauaacuuucu

SEQ ID NO: 139155 - RNA, 27 nt, Human
gucuggaacuccugagcucaagcaguc

SEQ ID NO: 139156 - RNA, 20 nt, Human
uacagaaauuauaagcacaa

SEQ ID NO: 139157 - RNA, 22 nt, Human
gacucagaaaccuccagaggaa

SEQ ID NO: 139158 - RNA, 27 nt, Human
ggagagggaggcugcagacgccuggga

SEQ ID NO: 139159 - RNA, 22 nt, Human
uagcuuuuaaaagaaaagcaaa

SEQ ID NO: 139160 - RNA, 26 nt, Human
aagagaggagccgucgcaggagccgc

SEQ ID NO: 139161 - RNA, 21 nt, Human
ggggcacugacccaggaggag

SEQ ID NO: 139162 - RNA, 23 nt, Human
cugccugugguccugagcacuga

SEQ ID NO: 139163 - RNA, 27 nt, Human
cagugcugagcagagcaagguuggguu

SEQ ID NO: 139164 - RNA, 22 nt, Human
ugcccugcuucuagggcucuga

SEQ ID NO: 139165 - RNA, 28 nt, Human
caccaauccucaccuaacaguuacuuua

SEQ ID NO: 139166 - RNA, 19 nt, Human
uucauauauuuaacuuugc

SEQ ID NO: 139167 - RNA, 21 nt, Human
gugacagaucacagggugagg

SEQ ID NO: 139168 - RNA, 19 nt, Human
agacuguagaugcauuuua

SEQ ID NO: 139169 - RNA, 21 nt, Human
ggcucgggggcucccggagca

SEQ ID NO: 139170 - RNA, 24 nt, Human
cuucuuaaugcuuuccucccuggc

SEQ ID NO: 139171 - RNA, 21 nt, Human
cccaguucugcuccucuccag

SEQ ID NO: 139172 - RNA, 27 nt, Human
gggaggcaccuccaggcaggccaggcu

SEQ ID NO: 139173 - RNA, 26 nt, Human
cuggucccugccucgguugauugugc

SEQ ID NO: 139174 - RNA, 21 nt, Human
cugcaaucccagcuacuugga

SEQ ID NO: 139175 - RNA, 22 nt, Human
gggccacacccucagcugccuc

SEQ ID NO: 139176 - RNA, 19 nt, Human
uugcccaggcuggagcgca

SEQ ID NO: 139177 - RNA, 27 nt, Human
ccccugccugccugauuccauggcugu

SEQ ID NO: 139178 - RNA, 20 nt, Human
ggacagaggccaggagccag

SEQ ID NO: 139179 - RNA, 32 nt, Human
guuuugaaguuuucaaagacuggcucugcugu

SEQ ID NO: 139180 - RNA, 27 nt, Human
ccuguccccacccccaccccagcagug

SEQ ID NO: 139181 - RNA, 20 nt, Human
gccauacuaaaaaugcucug

SEQ ID NO: 139182 - RNA, 26 nt, Human
ggggcuaggugucuccugggaggcau

SEQ ID NO: 139183 - RNA, 18 nt, Human
cagucucuggguugucau

SEQ ID NO: 139184 - RNA, 27 nt, Human
aagacuuguguccccgccucaggcugc

SEQ ID NO: 139185 - RNA, 24 nt, Human
gccaagucugcagcacagugacca

SEQ ID NO: 139186 - RNA, 24 nt, Human
aggacugaggcacugagggucccu

SEQ ID NO: 139187 - RNA, 26 nt, Human
cugccucucccugggucuggggacag

SEQ ID NO: 139188 - RNA, 22 nt, Human
ugucuuuaaaaauuugaucuug

SEQ ID NO: 139189 - RNA, 21 nt, Human
ugcuauaccuacuagguccaa

SEQ ID NO: 139190 - RNA, 22 nt, Human
cgugcuugaggccuggcagcug

SEQ ID NO: 139191 - RNA, 23 nt, Human
guggccaagaagcaguggccuua

SEQ ID NO: 139192 - RNA, 20 nt, Human
aaacccagaacucaaacuua

SEQ ID NO: 139193 - RNA, 21 nt, Human
uuuuugggagugacaaacauu

SEQ ID NO: 139194 - RNA, 21 nt, Human
auccagaggccugcugcagau

SEQ ID NO: 139195 - RNA, 24 nt, Human
cgccuggucucuggguuggcuguu

SEQ ID NO: 139196 - RNA, 26 nt, Human
gggacuguucuuuuacaagacaggac

SEQ ID NO: 139197 - RNA, 23 nt, Human
caacaaauaauuucugagugugu

SEQ ID NO: 139198 - RNA, 18 nt, Human
ccagaguuagaaaggagg

SEQ ID NO: 139199 - RNA, 22 nt, Human
auugcagccucagacuccuggg

SEQ ID NO: 139200 - RNA, 25 nt, Human
ucagaauaauuuggguuucuguaaa

SEQ ID NO: 139201 - RNA, 23 nt, Human
uccaggcccaaacaggcugaagc

SEQ ID NO: 139202 - RNA, 24 nt, Human
augggaaaugagaacauuccaagu

SEQ ID NO: 139203 - RNA, 26 nt, Human
ugcccagggggugcaaagaagagaca

SEQ ID NO: 139204 - RNA, 23 nt, Human
cugucucucagggccaggccucu

SEQ ID NO: 139205 - RNA, 22 nt, Human
accuguaaucccagcuacucug

SEQ ID NO: 139206 - RNA, 21 nt, Human
ggcuggacccuucccacuaca

SEQ ID NO: 139207 - RNA, 22 nt, Human
aaaccaggaacaauugacuccu

SEQ ID NO: 139208 - RNA, 22 nt, Human
ggaggugggggugggggcagcc

SEQ ID NO: 139209 - RNA, 23 nt, Human
ugcccugcuagaauuugcuuuuc

SEQ ID NO: 139210 - RNA, 25 nt, Human
ugcuauaauaaagaaaauucuugug

SEQ ID NO: 139211 - RNA, 27 nt, Human
guugcccaggcuggagugcaauggcau

SEQ ID NO: 139212 - RNA, 27 nt, Human
guugcccaggcuggaguacaauggcgu

SEQ ID NO: 139213 - RNA, 27 nt, Human
gucgcccaggcuggagugcaauggcac

SEQ ID NO: 139214 - RNA, 19 nt, Human
ucgcccgcugccucccucg

SEQ ID NO: 139215 - RNA, 25 nt, Human
cgcgggcuguccuggacccuaggag

SEQ ID NO: 139216 - RNA, 25 nt, Human
aagcaauucuccuucuucagccucc

SEQ ID NO: 139217 - RNA, 22 nt, Human
aguuuuauuuauuuuauccucu

SEQ ID NO: 139218 - RNA, 20 nt, Human
agcagagucuugcuaccuca

SEQ ID NO: 139219 - RNA, 24 nt, Human
ccagcauuucccuuccuuccucuc

SEQ ID NO: 139220 - RNA, 19 nt, Human
uucuacaaguaauuuugca

SEQ ID NO: 139221 - RNA, 21 nt, Human
uccuaggaggaaaauuccauu

SEQ ID NO: 139222 - RNA, 26 nt, Human
gagagcggcggccagggaggugcgga

SEQ ID NO: 139223 - RNA, 22 nt, Human
uccuuugguacaaaaggguuga

SEQ ID NO: 139224 - RNA, 23 nt, Human
uagucucuccauucuaaaguuua

SEQ ID NO: 139225 - RNA, 30 nt, Human
cacuguccagguggagacugagcaaaggaa

SEQ ID NO: 139226 - RNA, 19 nt, Human
gcccauggagggagguauu

SEQ ID NO: 139227 - RNA, 20 nt, Human
cgcccaggcuggaaugcagu

SEQ ID NO: 139228 - RNA, 27 nt, Human
gccccugcccauguacagcccccagac

SEQ ID NO: 139229 - RNA, 22 nt, Human
gggauuacaggcaugggccacc

SEQ ID NO: 139230 - RNA, 23 nt, Human
uauccuuuuaaaugcuaguaauc

SEQ ID NO: 139231 - RNA, 24 nt, Human
uggagaccgugaccagugcugcug

SEQ ID NO: 139232 - RNA, 21 nt, Human
uuucaugugcucagaauuauu

SEQ ID NO: 139233 - RNA, 21 nt, Human
gcaaaugaucagccuugcaaa

SEQ ID NO: 139234 - RNA, 23 nt, Human
guuuucagugcugugucauucca

SEQ ID NO: 139235 - RNA, 15 nt, Human
ccuccaccucaggcc

SEQ ID NO: 139236 - RNA, 19 nt, Human
cccuugugccgcaggcugg

SEQ ID NO: 139237 - RNA, 25 nt, Human
auauuuauccaaaauguaguugaca

SEQ ID NO: 139238 - RNA, 22 nt, Human
acuucuuuaacaaucuuguuug

SEQ ID NO: 139239 - RNA, 20 nt, Human
uugaagaagccacagaggcu

SEQ ID NO: 139240 - RNA, 22 nt, Human
aaacaauaaagaaagaaauauu

SEQ ID NO: 139241 - RNA, 27 nt, Human
ccccacccucagcguuggggauucacg

SEQ ID NO: 139242 - RNA, 23 nt, Human
caggcuacaguugaacagaacug

SEQ ID NO: 139243 - RNA, 21 nt, Human
augaaauauacauacuaggca

SEQ ID NO: 139244 - RNA, 25 nt, Human
ccccugagaaggccuggccccuucc

SEQ ID NO: 139245 - RNA, 23 nt, Human
caagagguggaacaugugaauga

SEQ ID NO: 139246 - RNA, 21 nt, Human
uagucugucuugacacacauu

SEQ ID NO: 139247 - RNA, 21 nt, Human
ggcucacugcaaccucugccu

SEQ ID NO: 139248 - RNA, 26 nt, Human
ccagugcuugcccugccugccaggaa

SEQ ID NO: 139249 - RNA, 21 nt, Human
acccuguguacuaagugcuuu

SEQ ID NO: 139250 - RNA, 23 nt, Human
gucaguuucagauccugaucuua

SEQ ID NO: 139251 - RNA, 24 nt, Human
ugugcguggcuccugaccugcugc

SEQ ID NO: 139252 - RNA, 23 nt, Human
gucacauugcaagugagugcagg

SEQ ID NO: 139253 - RNA, 27 nt, Human
ccacuacacuccagccugagcaacaga

SEQ ID NO: 139254 - RNA, 21 nt, Human
guucuagcuguuugcaucaaa

SEQ ID NO: 139255 - RNA, 22 nt, Human
uuuuaggaaacucaccuuccuc

SEQ ID NO: 139256 - RNA, 22 nt, Human
aacagaagaucccaaguuuuag

SEQ ID NO: 139257 - RNA, 24 nt, Human
uuugaaaaacacaaugauuccuuc

SEQ ID NO: 139258 - RNA, 28 nt, Human
gcccauggcccucaccuccaucaaugcc

SEQ ID NO: 139259 - RNA, 23 nt, Human
caugcccagcuguauggcugggg

SEQ ID NO: 139260 - RNA, 20 nt, Human
cucugcccucagaccuggcc

SEQ ID NO: 139261 - RNA, 22 nt, Human
gggucaaaggacaauaugggug

SEQ ID NO: 139262 - RNA, 24 nt, Human
ugagagaagagagagaugucccag

SEQ ID NO: 139263 - RNA, 22 nt, Human
acugaggaauuuucaugugcca

SEQ ID NO: 139264 - RNA, 27 nt, Human
guuucaauauuucuuaacugggguguc

SEQ ID NO: 139265 - RNA, 27 nt, Human
uucucucuuggaucaaauaugucuuua

SEQ ID NO: 139266 - RNA, 24 nt, Human
gcaaucagcugaguugagacuuug

SEQ ID NO: 139267 - RNA, 21 nt, Human
gugguuucuugugcacuggca

SEQ ID NO: 139268 - RNA, 21 nt, Human
ccucuccuggugcuccaagca

SEQ ID NO: 139269 - RNA, 25 nt, Human
acugggccacguacaagcagggcuu

SEQ ID NO: 139270 - RNA, 21 nt, Human
gggaagaaaagagggagcagc

SEQ ID NO: 139271 - RNA, 25 nt, Human
cccaucucagagcucagaggguaca

SEQ ID NO: 139272 - RNA, 19 nt, Human
ucuuccuauauccuggaau

SEQ ID NO: 139273 - RNA, 27 nt, Human
ggaaaguuggaaccguguccagcacag

SEQ ID NO: 139274 - RNA, 19 nt, Human
uuuccuccuucccuccuuu

SEQ ID NO: 139275 - RNA, 25 nt, Human
gaagugcuguggaaaccgucaggcc

SEQ ID NO: 139276 - RNA, 23 nt, Human
gccaugcugggaagacgccugag

SEQ ID NO: 139277 - RNA, 27 nt, Human
gucacauuuaguaaaugcugaaauaaa

SEQ ID NO: 139278 - RNA, 23 nt, Human
gugucugugccccuguguguguu

SEQ ID NO: 139279 - RNA, 21 nt, Human
cugggggugaggacacauugc

SEQ ID NO: 139280 - RNA, 25 nt, Human
ucucuuccugucuuuguggcuccgg

SEQ ID NO: 139281 - RNA, 22 nt, Human
agauaaaugugcaaaccuguuc

SEQ ID NO: 139282 - RNA, 24 nt, Human
aagaggaagcuuucugucuccuua

SEQ ID NO: 139283 - RNA, 29 nt, Human
ccaaaaaucgacagccacugagaccggcu

SEQ ID NO: 139284 - RNA, 22 nt, Human
gcucucacugggcgcuguagaa

SEQ ID NO: 139285 - RNA, 27 nt, Human
aggagguucuccacugugguggucugg

SEQ ID NO: 139286 - RNA, 24 nt, Human
gccagagcuggagcacguuuggug

SEQ ID NO: 139287 - RNA, 22 nt, Human
gcccaggaaauccacagcagug

SEQ ID NO: 139288 - RNA, 26 nt, Human
acaggcugggacucagaguuauuucc

SEQ ID NO: 139289 - RNA, 22 nt, Human
ccaugcagcuggcguagguggc

SEQ ID NO: 139290 - RNA, 24 nt, Human
gggugagggauaaaaugaggcucc

SEQ ID NO: 139291 - RNA, 20 nt, Human
uuucaggaagguggagcugc

SEQ ID NO: 139292 - RNA, 22 nt, Human
ugcucaccucuagccuuaaggg

SEQ ID NO: 139293 - RNA, 27 nt, Human
gaguccccaauaaaccugugguccugc

SEQ ID NO: 139294 - RNA, 28 nt, Human
uccuucggggcaccucaggcagcaaacc

SEQ ID NO: 139295 - RNA, 22 nt, Human
ucuccuccugcaccuguguccc

SEQ ID NO: 139296 - RNA, 22 nt, Human
aaaaacccacaaaaauguugaa

SEQ ID NO: 139297 - RNA, 20 nt, Human
cgcugggaucugauugagga

SEQ ID NO: 139298 - RNA, 21 nt, Human
ggcuuccuuucuuccuuguaa

SEQ ID NO: 139299 - RNA, 22 nt, Human
cacuacugcauuccagccuggg

SEQ ID NO: 139300 - RNA, 21 nt, Human
auugcagcaaguuacaaaggg

SEQ ID NO: 139301 - RNA, 24 nt, Human
agcuaaauuuuuaauauuuuugua

SEQ ID NO: 139302 - RNA, 27 nt, Human
uucuaauucccuucuccuauccuccug

SEQ ID NO: 139303 - RNA, 23 nt, Human
uccuuuggaggaagggaaugaaa

SEQ ID NO: 139304 - RNA, 21 nt, Human
aguuguccucaugaauuagcu

SEQ ID NO: 139305 - RNA, 30 nt, Human
uucccaaugucauauccaccaggaccuggc

SEQ ID NO: 139306 - RNA, 27 nt, Human
aaguaagaaacaauuauaauuucuuua

SEQ ID NO: 139307 - RNA, 18 nt, Human
aacaucauuuccacagac

SEQ ID NO: 139308 - RNA, 16 nt, Human
agcauuagauguaaua

SEQ ID NO: 139309 - RNA, 24 nt, Human
gggcuccugccccuuucaggccua

SEQ ID NO: 139310 - RNA, 20 nt, Human
gacuaaaaucugcuguagcu

SEQ ID NO: 139311 - RNA, 26 nt, Human
uccuugaggcaggaauacugaggugc

SEQ ID NO: 139312 - RNA, 22 nt, Human
cuugguuugugacugcaucucc

SEQ ID NO: 139313 - RNA, 22 nt, Human
ugcuuguacugggacauuguuc

SEQ ID NO: 139314 - RNA, 21 nt, Human
cauuucauuugugccaaaaau

SEQ ID NO: 139315 - RNA, 20 nt, Human
gcccggcuucucuugccgac

SEQ ID NO: 139316 - RNA, 27 nt, Human
ccuccucuggcccaggacgccugcugc

SEQ ID NO: 139317 - RNA, 22 nt, Human
ggugguggggacuaggggagcc

SEQ ID NO: 139318 - RNA, 22 nt, Human
gcugcacucuugaacugggcga

SEQ ID NO: 139319 - RNA, 25 nt, Human
uaguuucagugacuuguuauaucua

SEQ ID NO: 139320 - RNA, 19 nt, Human
cagccccgcucaccugcca

SEQ ID NO: 139321 - RNA, 18 nt, Human
ccauugccauuugguaca

SEQ ID NO: 139322 - RNA, 29 nt, Human
ugcuaguacaucauucaugaucaccuuaa

SEQ ID NO: 139323 - RNA, 26 nt, Human
gugccucuuccacucuggagugaagu

SEQ ID NO: 139324 - RNA, 23 nt, Human
agucuaauucugaaaauaucuca

SEQ ID NO: 139325 - RNA, 20 nt, Human
uugcaggaccccuguccuca

SEQ ID NO: 139326 - RNA, 22 nt, Human
gguuuuggggucccggacucug

SEQ ID NO: 139327 - RNA, 26 nt, Human
accuuaguuugcugccaucagucuag

SEQ ID NO: 139328 - RNA, 23 nt, Human
cucuucugcugaccucagauacc

SEQ ID NO: 139329 - RNA, 22 nt, Human
ugagcacacaggugaacuccag

SEQ ID NO: 139330 - RNA, 21 nt, Human
accaagcucuugacucuguuu

SEQ ID NO: 139331 - RNA, 25 nt, Human
ucaaaccccaaaccagcccgaggag

SEQ ID NO: 139332 - RNA, 21 nt, Human
uggagaggaaaccagauugga

SEQ ID NO: 139333 - RNA, 19 nt, Human
caucacaggcucagccuuu

SEQ ID NO: 139334 - RNA, 21 nt, Human
agcuaaauuuguauugguuca

SEQ ID NO: 139335 - RNA, 23 nt, Human
auaaaugcagaggcaaaguguag

SEQ ID NO: 139336 - RNA, 22 nt, Human
auugagacaggcuggaguccag

SEQ ID NO: 139337 - RNA, 26 nt, Human
cccugccucuguggcucugccugugg

SEQ ID NO: 139338 - RNA, 26 nt, Human
cagguccacaccagccugggcaacac

SEQ ID NO: 139339 - RNA, 21 nt, Human
augaagcugucuugugccagu

SEQ ID NO: 139340 - RNA, 20 nt, Human
cugcuuuggguugugagugg

SEQ ID NO: 139341 - RNA, 26 nt, Human
cccugguuuuucaauccccagggucg

SEQ ID NO: 139342 - RNA, 20 nt, Human
ugugggcucagauccugggc

SEQ ID NO: 139343 - RNA, 22 nt, Human
cagcuacaagaacuuucuugaa

SEQ ID NO: 139344 - RNA, 22 nt, Human
ucaucccuucuguggcaguuag

SEQ ID NO: 139345 - RNA, 21 nt, Human
ggaauucugcauccagcucua

SEQ ID NO: 139346 - RNA, 20 nt, Human
ggaaaugcuagguuuuugug

SEQ ID NO: 139347 - RNA, 20 nt, Human
ugguggcagaggugggauga

SEQ ID NO: 139348 - RNA, 21 nt, Human
uuggaauuucuuggccuacua

SEQ ID NO: 139349 - RNA, 17 nt, Human
gugaagcccaggccagg

SEQ ID NO: 139350 - RNA, 24 nt, Human
uggaaagaaaaaguucaucacaga

SEQ ID NO: 139351 - RNA, 22 nt, Human
cuggacuccggaggacugagcc

SEQ ID NO: 139352 - RNA, 21 nt, Human
gggccgaagaagagauuuccu

SEQ ID NO: 139353 - RNA, 22 nt, Human
gccucacuccccuccucccgcu

SEQ ID NO: 139354 - RNA, 27 nt, Human
ucucuucccggcuuggcaaucucagcu

SEQ ID NO: 139355 - RNA, 22 nt, Human
gaggaagaaacuaaaggaagua

SEQ ID NO: 139356 - RNA, 23 nt, Human
aaaugugucuucagcuggcagca

SEQ ID NO: 139357 - RNA, 22 nt, Human
ccucugccugcaccuuccugcg

SEQ ID NO: 139358 - RNA, 20 nt, Human
ugggaggcgggaguggagug

SEQ ID NO: 139359 - RNA, 27 nt, Human
uugcagcuguaucucacacuaugauuu

SEQ ID NO: 139360 - RNA, 23 nt, Human
cagggcugaagaacaaacucuug

SEQ ID NO: 139361 - RNA, 27 nt, Human
aggugcuuucucaguugaggagaggug

SEQ ID NO: 139362 - RNA, 21 nt, Human
uggggaggggcuccguguagc

SEQ ID NO: 139363 - RNA, 23 nt, Human
ugauacuucuuuuuaucucuuua

SEQ ID NO: 139364 - RNA, 22 nt, Human
ucaugcuggucaugaccugaag

SEQ ID NO: 139365 - RNA, 22 nt, Human
agaccagccuggccaacauggu

SEQ ID NO: 139366 - RNA, 22 nt, Human
agaccagccuggcuaacauggc

SEQ ID NO: 139367 - RNA, 20 nt, Human
cuuucugcuuuccuuccucc

SEQ ID NO: 139368 - RNA, 21 nt, Human
cagguucuuaacagccugugc

SEQ ID NO: 139369 - RNA, 27 nt, Human
gaaagagaguucuuucuuaauaaagaa

SEQ ID NO: 139370 - RNA, 21 nt, Human
acuucagucuugccuaggcga

SEQ ID NO: 139371 - RNA, 22 nt, Human
uagggagggcggaaagggaggc

SEQ ID NO: 139372 - RNA, 22 nt, Human
guuacuaagucaggaguguagu

SEQ ID NO: 139373 - RNA, 21 nt, Human
uguuagaugcauaagcauuuu

SEQ ID NO: 139374 - RNA, 27 nt, Human
uggcuauacugaaaucuguuauuuuag

SEQ ID NO: 139375 - RNA, 27 nt, Human
acuugaggugaauuuuggagugaaggg

SEQ ID NO: 139376 - RNA, 22 nt, Human
guagguugaggacaggagaggg

SEQ ID NO: 139377 - RNA, 22 nt, Human
ggagcugccucuuuacagcuuc

SEQ ID NO: 139378 - RNA, 22 nt, Human
gcuggcgccuguaaucccagcu

SEQ ID NO: 139379 - RNA, 18 nt, Human
guacucucacauguggca

SEQ ID NO: 139380 - RNA, 23 nt, Human
agaauuccagggucacagcccca

SEQ ID NO: 139381 - RNA, 22 nt, Human
agaccagccugaccaacacgga

SEQ ID NO: 139382 - RNA, 27 nt, Human
ugccagaccauucucuggcggggacca

SEQ ID NO: 139383 - RNA, 24 nt, Human
gcacacuccagucuuggugguucc

SEQ ID NO: 139384 - RNA, 27 nt, Human
ggucucgacccuggaccuccugaggga

SEQ ID NO: 139385 - RNA, 23 nt, Human
uugcaggcugacauuacauucug

SEQ ID NO: 139386 - RNA, 22 nt, Human
agcgaauaagugcaggucuccg

SEQ ID NO: 139387 - RNA, 19 nt, Human
ucuccugagcucgugaucu

SEQ ID NO: 139388 - RNA, 21 nt, Human
cugucccaggggucucccuga

SEQ ID NO: 139389 - RNA, 20 nt, Human
uggcuuugaacauuuugggg

SEQ ID NO: 139390 - RNA, 27 nt, Human
gguuauuuuauuuauuguaagcauuuu

SEQ ID NO: 139391 - RNA, 17 nt, Human
auucagaagaaaaagaa

SEQ ID NO: 139392 - RNA, 20 nt, Human
agccaucccagagccugggg

SEQ ID NO: 139393 - RNA, 21 nt, Human
ugcuggcacucagagcuccuc

SEQ ID NO: 139394 - RNA, 24 nt, Human
ucugccgcugucccccaccugcug

SEQ ID NO: 139395 - RNA, 25 nt, Human
ccugcacuccacaugaugaggucag

SEQ ID NO: 139396 - RNA, 21 nt, Human
cuucuucuuuaggauugugau

SEQ ID NO: 139397 - RNA, 22 nt, Human
caggcagcucugggaccuagga

SEQ ID NO: 139398 - RNA, 24 nt, Human
ccauguuggccaggcuggucucca

SEQ ID NO: 139399 - RNA, 21 nt, Human
cgcagugugcacuaaggggcc

SEQ ID NO: 139400 - RNA, 23 nt, Human
cuuuuucaaugaaagagaaggaa

SEQ ID NO: 139401 - RNA, 21 nt, Human
ccacagacaucauugcuguuc

SEQ ID NO: 139402 - RNA, 24 nt, Human
aggcuacuauucauccucugugau

SEQ ID NO: 139403 - RNA, 22 nt, Human
uuuuugguacugagagucucaa

SEQ ID NO: 139404 - RNA, 26 nt, Human
ucaucuuuguggauggugucuccuuu

SEQ ID NO: 139405 - RNA, 20 nt, Human
cauuuucagcacuuacuuca

SEQ ID NO: 139406 - RNA, 27 nt, Human
ugucauugucugccuuuaaaauccuuc

SEQ ID NO: 139407 - RNA, 22 nt, Human
cagggagggggguuauuaggau

SEQ ID NO: 139408 - RNA, 18 nt, Human
ggcuucccacugaaggga

SEQ ID NO: 139409 - RNA, 23 nt, Human
gugggcaggaaagaaaggcuccu

SEQ ID NO: 139410 - RNA, 22 nt, Human
aaccaagugccuccugucugaa

SEQ ID NO: 139411 - RNA, 26 nt, Human
aaucccugggagcgccugacccuggu

SEQ ID NO: 139412 - RNA, 26 nt, Human
ggaccccagccccuaucuccaagaga

SEQ ID NO: 139413 - RNA, 27 nt, Human
caggcuggagugcaauggcgugaucuc

SEQ ID NO: 139414 - RNA, 27 nt, Human
caggcuagagugcaguggcgugaucuc

SEQ ID NO: 139415 - RNA, 22 nt, Human
ggcugcagguauuaaguccaag

SEQ ID NO: 139416 - RNA, 20 nt, Human
cucugcucucacguggcacc

SEQ ID NO: 139417 - RNA, 26 nt, Human
uacuguuuucugggccagugagccag

SEQ ID NO: 139418 - RNA, 25 nt, Human
gcccaaucucugcuggucagucacg

SEQ ID NO: 139419 - RNA, 26 nt, Human
cuggucuccgcggcacccacuggggc

SEQ ID NO: 139420 - RNA, 25 nt, Human
gcuccugcggcagcuccucugggca

SEQ ID NO: 139421 - RNA, 21 nt, Human
gcuuucuuucccuuacucccu

SEQ ID NO: 139422 - RNA, 20 nt, Human
gugacaacaggaccaaccug

SEQ ID NO: 139423 - RNA, 25 nt, Human
gcucuucuucugugucucuauuucu

SEQ ID NO: 139424 - RNA, 24 nt, Human
aucuuaacacagaacaugagguua

SEQ ID NO: 139425 - RNA, 22 nt, Human
uacuguuuuuaauguucacauu

SEQ ID NO: 139426 - RNA, 20 nt, Human
cucuccaccucaggccuugg

SEQ ID NO: 139427 - RNA, 23 nt, Human
acccuccacaggcuugagcccag

SEQ ID NO: 139428 - RNA, 25 nt, Human
ugguagugcacaccuguaguccuag

SEQ ID NO: 139429 - RNA, 23 nt, Human
cugaccagagcugaggaacugug

SEQ ID NO: 139430 - RNA, 18 nt, Human
gacuuuagggaaggugaa

SEQ ID NO: 139431 - RNA, 26 nt, Human
ccuacauuccuuacacaagugccuaa

SEQ ID NO: 139432 - RNA, 16 nt, Human
cgcggcccgggcacag

SEQ ID NO: 139433 - RNA, 26 nt, Human
cagcuuuaauggaauauugggugaau

SEQ ID NO: 139434 - RNA, 24 nt, Human
ugucuucuuugcuagagaagugga

SEQ ID NO: 139435 - RNA, 22 nt, Human
ccugcuccggcucacacacgcc

SEQ ID NO: 139436 - RNA, 25 nt, Human
uugccuugccugauaaccagccagc

SEQ ID NO: 139437 - RNA, 24 nt, Human
cuuaccaucuuacuccugccuccc

SEQ ID NO: 139438 - RNA, 19 nt, Human
uccccuuccugucugccca

SEQ ID NO: 139439 - RNA, 24 nt, Human
acuaacuuuccaaggccugccuuc

SEQ ID NO: 139440 - RNA, 22 nt, Human
gugaauauauguauauguguac

SEQ ID NO: 139441 - RNA, 22 nt, Human
ccaaaauucugggauuacaggc

SEQ ID NO: 139442 - RNA, 19 nt, Human
gcagagcaaggugcugcug

SEQ ID NO: 139443 - RNA, 18 nt, Human
ucauuaaaaaugggauuc

SEQ ID NO: 139444 - RNA, 22 nt, Human
acgccuguaauccuagcacuuu

SEQ ID NO: 139445 - RNA, 24 nt, Human
cagugcauccagguccugccuugu

SEQ ID NO: 139446 - RNA, 22 nt, Human
uccggacuugcccuaugggaga

SEQ ID NO: 139447 - RNA, 23 nt, Human
cucggcuccagggaggugucauu

SEQ ID NO: 139448 - RNA, 25 nt, Human
ggcaagggccuucuugcugcuucau

SEQ ID NO: 139449 - RNA, 21 nt, Human
agugcaagacgaugacuugca

SEQ ID NO: 139450 - RNA, 24 nt, Human
auaaaauguuguggaaaagguagc

SEQ ID NO: 139451 - RNA, 21 nt, Human
cccacagaugucuuggacagu

SEQ ID NO: 139452 - RNA, 20 nt, Human
cugccaccucauguucacac

SEQ ID NO: 139453 - RNA, 26 nt, Human
gaguaugacgaugguauuuaucugua

SEQ ID NO: 139454 - RNA, 23 nt, Human
cuuaucaucacacaacucagccu

SEQ ID NO: 139455 - RNA, 23 nt, Human
aagaguuuuucaaaauuagccag

SEQ ID NO: 139456 - RNA, 20 nt, Human
gauugccaggacuaagccau

SEQ ID NO: 139457 - RNA, 22 nt, Human
augccuugguggggccuguguc

SEQ ID NO: 139458 - RNA, 26 nt, Human
ggcacuugcucccugggcaacuccuu

SEQ ID NO: 139459 - RNA, 26 nt, Human
cggagcgcagccugggcccagcccac

SEQ ID NO: 139460 - RNA, 18 nt, Human
uuguacagcuagaaaagg

SEQ ID NO: 139461 - RNA, 27 nt, Human
ugacccaugaagggaacucauuuuccu

SEQ ID NO: 139462 - RNA, 20 nt, Human
ccccaaaauaggguuuucuu

SEQ ID NO: 139463 - RNA, 18 nt, Human
cccaaaggaaacuacucu

SEQ ID NO: 139464 - RNA, 27 nt, Human
agaccagccugaccaaaauggugaaac

SEQ ID NO: 139465 - RNA, 30 nt, Human
cuccagccuccucccuauuggaaucccaau

SEQ ID NO: 139466 - RNA, 23 nt, Human
aaaguugaaaaaauaaaugcagg

SEQ ID NO: 139467 - RNA, 20 nt, Human
ucauauccuucuuacacgac

SEQ ID NO: 139468 - RNA, 28 nt, Human
gcuauuuaucuucugaguucccagcaau

SEQ ID NO: 139469 - RNA, 25 nt, Human
ccuucuuauucucuuccucuggcug

SEQ ID NO: 139470 - RNA, 27 nt, Human
acacuccaagucucagauaucugggaa

SEQ ID NO: 139471 - RNA, 26 nt, Human
gaggagaccuggggcugugcaucugg

SEQ ID NO: 139472 - RNA, 22 nt, Human
cugugauuaugccauugcacuc

SEQ ID NO: 139473 - RNA, 22 nt, Human
cugcccgccugcccaccugccu

SEQ ID NO: 139474 - RNA, 26 nt, Human
guagagucugagacgggcaagugguu

SEQ ID NO: 139475 - RNA, 31 nt, Human
ccucuuccugaugggcaaccacaccacugcc

SEQ ID NO: 139476 - RNA, 22 nt, Human
gacucacugcaaucuccaccuc

SEQ ID NO: 139477 - RNA, 22 nt, Human
ggcuuacugcaaccuccgccuc

SEQ ID NO: 139478 - RNA, 21 nt, Human
gccucaucuuccucaguuuca

SEQ ID NO: 139479 - RNA, 21 nt, Human
ucagaaauaugacuuauuucu

SEQ ID NO: 139480 - RNA, 23 nt, Human
gggaggcacggggaagguuuugg

SEQ ID NO: 139481 - RNA, 23 nt, Human
uccccagguauggagcacacucu

SEQ ID NO: 139482 - RNA, 22 nt, Human
cccaccccacuuguaugcucug

SEQ ID NO: 139483 - RNA, 23 nt, Human
ccuccuaaucugggccucuuguc

SEQ ID NO: 139484 - RNA, 24 nt, Human
cccaacaacuccaggcccugcccc

SEQ ID NO: 139485 - RNA, 24 nt, Human
ggccuguagcucuucuuucuugga

SEQ ID NO: 139486 - RNA, 15 nt, Human
agcuucuuacugaac

SEQ ID NO: 139487 - RNA, 17 nt, Human
cuggauuuucuuucuau

SEQ ID NO: 139488 - RNA, 29 nt, Human
cagccagacggaaaggcggcugcuugccu

SEQ ID NO: 139489 - RNA, 28 nt, Human
caucacucgaacuccagcuucaagaaug

SEQ ID NO: 139490 - RNA, 21 nt, Human
ggggaaagagaagcuggggau

SEQ ID NO: 139491 - RNA, 29 nt, Human
accaugaaaaugagaggaggaaagacauc

SEQ ID NO: 139492 - RNA, 22 nt, Human
acuguguggccccugccugugc

SEQ ID NO: 139493 - RNA, 22 nt, Human
cccaucaucuuggaugcugccc

SEQ ID NO: 139494 - RNA, 21 nt, Human
ccugaaacaagcucauuucag

SEQ ID NO: 139495 - RNA, 22 nt, Human
gggcugacucuccagggagcug

SEQ ID NO: 139496 - RNA, 22 nt, Human
ugcuaucuuaauuuugguugua

SEQ ID NO: 139497 - RNA, 25 nt, Human
gccugcguugccacuugucuuaacu

SEQ ID NO: 139498 - RNA, 20 nt, Human
gucaugguccgguguccuuu

SEQ ID NO: 139499 - RNA, 21 nt, Human
gagaggcugucaggcagcagc

SEQ ID NO: 139500 - RNA, 23 nt, Human
uuuacuuuuuaaaaugauuuaga

SEQ ID NO: 139501 - RNA, 28 nt, Human
uccugcacaccuuccgcacaccucccuc

SEQ ID NO: 139502 - RNA, 21 nt, Human
gacccgggaagaacuggugag

SEQ ID NO: 139503 - RNA, 22 nt, Human
ccagagcuggggaaacccagaa

SEQ ID NO: 139504 - RNA, 19 nt, Human
uguaggaaccgaucugcua

SEQ ID NO: 139505 - RNA, 23 nt, Human
gcaaacccacaaagcaucaaaag

SEQ ID NO: 139506 - RNA, 21 nt, Human
uuuccccccucuuccuucaca

SEQ ID NO: 139507 - RNA, 24 nt, Human
gagcagcagccacugcacaggagg

SEQ ID NO: 139508 - RNA, 24 nt, Human
aacuggguggagaaagaauggaaa

SEQ ID NO: 139509 - RNA, 21 nt, Human
cacuucagagccccucuagca

SEQ ID NO: 139510 - RNA, 22 nt, Human
ggcuuggaugcuucgggcuucu

SEQ ID NO: 139511 - RNA, 19 nt, Human
cuacucacccucucugcug

SEQ ID NO: 139512 - RNA, 23 nt, Human
gacucugcaagugucuggagcgg

SEQ ID NO: 139513 - RNA, 20 nt, Human
ccagauaccugccucguccg

SEQ ID NO: 139514 - RNA, 19 nt, Human
gcuccuccuugcccccacc

SEQ ID NO: 139515 - RNA, 26 nt, Human
ccaguuucaaaccccaaagauguaua

SEQ ID NO: 139516 - RNA, 23 nt, Human
cagaaccucucuggaauuugugc

SEQ ID NO: 139517 - RNA, 21 nt, Human
auccagaguucaugcuuagaa

SEQ ID NO: 139518 - RNA, 25 nt, Human
ugcccaggcuggaauccaagagugg

SEQ ID NO: 139519 - RNA, 25 nt, Human
ggagugcuggcauuacccucugcag

SEQ ID NO: 139520 - RNA, 24 nt, Human
cccagcccugggcaaggaagcuuu

SEQ ID NO: 139521 - RNA, 21 nt, Human
ccaacaacaacgagguuccua

SEQ ID NO: 139522 - RNA, 26 nt, Human
uugccuuucuccuagucaccaagcau

SEQ ID NO: 139523 - RNA, 25 nt, Human
gugguggcaaaguuaggauagcucu

SEQ ID NO: 139524 - RNA, 23 nt, Human
uuuuuuaaaaaacacacaucuua

SEQ ID NO: 139525 - RNA, 25 nt, Human
auacauacaucuaucuacaucugcc

SEQ ID NO: 139526 - RNA, 23 nt, Human
ugaccagcccaguuucaaacucc

SEQ ID NO: 139527 - RNA, 16 nt, Human
ggggugaguaggcuuc

SEQ ID NO: 139528 - RNA, 22 nt, Human
uucucuaccaagcuauccuggc

SEQ ID NO: 139529 - RNA, 25 nt, Human
uccaauggcugggauuuguggcagg

SEQ ID NO: 139530 - RNA, 19 nt, Human
cuagagauuuucacuccuc

SEQ ID NO: 139531 - RNA, 27 nt, Human
cccaaguagcugggacuauuuugcaug

SEQ ID NO: 139532 - RNA, 25 nt, Human
ugcaagcucuggccggcgcugccca

SEQ ID NO: 139533 - RNA, 22 nt, Human
guguugggcaugugaucacgcc

SEQ ID NO: 139534 - RNA, 22 nt, Human
ccugggugccuacagcagccag

SEQ ID NO: 139535 - RNA, 20 nt, Human
gcucguuccuucacacucag

SEQ ID NO: 139536 - RNA, 21 nt, Human
ucccaggaagcagaacucucc

SEQ ID NO: 139537 - RNA, 22 nt, Human
caaggaggcuuugagucacauc

SEQ ID NO: 139538 - RNA, 26 nt, Human
acuacccccuuaugauccuucacauu

SEQ ID NO: 139539 - RNA, 23 nt, Human
ggcagcuggaccaagggagccag

SEQ ID NO: 139540 - RNA, 28 nt, Human
cuaccuugagacccucuucucugggccc

SEQ ID NO: 139541 - RNA, 26 nt, Human
ccaggaacugaacccaaaggaucacc

SEQ ID NO: 139542 - RNA, 25 nt, Human
cguuuaaugguaucuguuacuccaa

SEQ ID NO: 139543 - RNA, 21 nt, Human
gcgcaacccacaaacccagug

SEQ ID NO: 139544 - RNA, 26 nt, Human
caggaggcaugagguacaaugccugc

SEQ ID NO: 139545 - RNA, 25 nt, Human
aguuugaauauuuuccacaagaugc

SEQ ID NO: 139546 - RNA, 22 nt, Human
auuucuauuugcacugugccuu

SEQ ID NO: 139547 - RNA, 22 nt, Human
uuccaguaucauacuuacuagu

SEQ ID NO: 139548 - RNA, 20 nt, Human
aaugcagauauuucuguggg

SEQ ID NO: 139549 - RNA, 20 nt, Human
uccgagcagaggccuggacu

SEQ ID NO: 139550 - RNA, 22 nt, Human
caucaucucacacuuucauguu

SEQ ID NO: 139551 - RNA, 24 nt, Human
gggaaggagacuggaagcugguuc

SEQ ID NO: 139552 - RNA, 25 nt, Human
ucucccacucuacugaaacccggaa

SEQ ID NO: 139553 - RNA, 26 nt, Human
cagcagccaacuuauuggcaugaugg

SEQ ID NO: 139554 - RNA, 27 nt, Human
ucccacacccuuuacauuccccagagc

SEQ ID NO: 139555 - RNA, 23 nt, Human
ggcccaggacuguggagugugug

SEQ ID NO: 139556 - RNA, 24 nt, Human
ucaguucuuugcuggcucucagcu

SEQ ID NO: 139557 - RNA, 23 nt, Human
gcccccgaccucccgggcucagg

SEQ ID NO: 139558 - RNA, 23 nt, Human
ugaacaacucuggagcagcuguc

SEQ ID NO: 139559 - RNA, 24 nt, Human
ggguccagaagagagaggaggcac

SEQ ID NO: 139560 - RNA, 26 nt, Human
gagaaaagucuaccccugcuaaggag

SEQ ID NO: 139561 - RNA, 22 nt, Human
ccugcuguucuguccuuccauc

SEQ ID NO: 139562 - RNA, 22 nt, Human
caccauugcgcuucagccuggg

SEQ ID NO: 139563 - RNA, 22 nt, Human
caggugcagagguucugaggga

SEQ ID NO: 139564 - RNA, 21 nt, Human
ucucucuggucacugcccuua

SEQ ID NO: 139565 - RNA, 24 nt, Human
ggacaagagaauagcugugguuug

SEQ ID NO: 139566 - RNA, 23 nt, Human
aagguuuucuccacuuuguugga

SEQ ID NO: 139567 - RNA, 23 nt, Human
uauuguccagacaagagucacug

SEQ ID NO: 139568 - RNA, 27 nt, Human
ccugccuguguucugugcccugugucc

SEQ ID NO: 139569 - RNA, 19 nt, Human
ccuugcaggaaugagucac

SEQ ID NO: 139570 - RNA, 19 nt, Human
agccacugaagcugggauu

SEQ ID NO: 139571 - RNA, 21 nt, Human
ggcuacaggugccccaccucc

SEQ ID NO: 139572 - RNA, 21 nt, Human
uccucuuccuccuccuccucc

SEQ ID NO: 139573 - RNA, 27 nt, Human
cugggaggggagagggugcgaccaagc

SEQ ID NO: 139574 - RNA, 22 nt, Human
cgcccaggcuggaguacagugg

SEQ ID NO: 139575 - RNA, 22 nt, Human
cgcccagacuggagugcagugg

SEQ ID NO: 139576 - RNA, 27 nt, Human
cagucucuuguacucuguguccugguc

SEQ ID NO: 139577 - RNA, 23 nt, Human
ggaagagaagaacuugaacccag

SEQ ID NO: 139578 - RNA, 27 nt, Human
aaaacauuuuaaguuuuacugauaauu

SEQ ID NO: 139579 - RNA, 28 nt, Human
ugcauggaccucugggcagggagaccug

SEQ ID NO: 139580 - RNA, 25 nt, Human
cauccuccggcgcgaugccaaaaag

SEQ ID NO: 139581 - RNA, 23 nt, Human
gcagccaggacacugcccacugg

SEQ ID NO: 139582 - RNA, 24 nt, Human
acugauuuccuuuuuaguccucua

SEQ ID NO: 139583 - RNA, 22 nt, Human
caggcuggagugcgguggugga

SEQ ID NO: 139584 - RNA, 21 nt, Human
uacuauacaacaauguucuuu

SEQ ID NO: 139585 - RNA, 24 nt, Human
gacagaauguggucugucagcugu

SEQ ID NO: 139586 - RNA, 23 nt, Human
auccccagccagaaguuaguguc

SEQ ID NO: 139587 - RNA, 22 nt, Human
gcgaucuugguucacugcaacc

SEQ ID NO: 139588 - RNA, 20 nt, Human
cuaccucaaacuuccaguca

SEQ ID NO: 139589 - RNA, 20 nt, Human
ucuggguggacaagacgcug

SEQ ID NO: 139590 - RNA, 27 nt, Human
ucugggccacucaggccagugcacccc

SEQ ID NO: 139591 - RNA, 21 nt, Human
agggacgacuuucuuuaacau

SEQ ID NO: 139592 - RNA, 29 nt, Human
cacauagcaagagcccagcucuugggagc

SEQ ID NO: 139593 - RNA, 21 nt, Human
ccucucuucugcacagcuccu

SEQ ID NO: 139594 - RNA, 20 nt, Human
ccccacccucuuccuguguc

SEQ ID NO: 139595 - RNA, 23 nt, Human
uauaccaaggaauacuauauaaa

SEQ ID NO: 139596 - RNA, 24 nt, Human
ggaagagggguuaaggugcaguga

SEQ ID NO: 139597 - RNA, 19 nt, Human
gaggagaggaagagccgca

SEQ ID NO: 139598 - RNA, 23 nt, Human
ccaggaggaagagguugcaguga

SEQ ID NO: 139599 - RNA, 17 nt, Human
ucuguuagacuaggcaa

SEQ ID NO: 139600 - RNA, 26 nt, Human
uugagacggagucucacucugucacc

SEQ ID NO: 139601 - RNA, 26 nt, Human
uugagacagagucuuacucuguugcc

SEQ ID NO: 139602 - RNA, 26 nt, Human
uugagacagagucucgcucugucacc

SEQ ID NO: 139603 - RNA, 19 nt, Human
gacuucagaaaccagagca

SEQ ID NO: 139604 - RNA, 23 nt, Human
uacugaugaagaaacugaggcca

SEQ ID NO: 139605 - RNA, 21 nt, Human
uucuguauaaaaacaaaagca

SEQ ID NO: 139606 - RNA, 21 nt, Human
cuggggcaaucaauggaugaa

SEQ ID NO: 139607 - RNA, 22 nt, Human
aauggccugcaaaccuuuuuua

SEQ ID NO: 139608 - RNA, 26 nt, Human
uguuuuuacaggugugaaagucacag

SEQ ID NO: 139609 - RNA, 26 nt, Human
uggagggcauugcaugaggucugcca

SEQ ID NO: 139610 - RNA, 21 nt, Human
guuuauuuacaguauaacucc

SEQ ID NO: 139611 - RNA, 22 nt, Human
ucauuuuuuacuuccucucuga

SEQ ID NO: 139612 - RNA, 25 nt, Human
uuugucacuuugccucaguugagca

SEQ ID NO: 139613 - RNA, 22 nt, Human
auauguugugagcaucuuucca

SEQ ID NO: 139614 - RNA, 22 nt, Human
ugaggggacugggcaguucuag

SEQ ID NO: 139615 - RNA, 20 nt, Human
aaacaaacuaacacaaaaua

SEQ ID NO: 139616 - RNA, 22 nt, Human
ucugucucccaggcugaagugc

SEQ ID NO: 139617 - RNA, 21 nt, Human
guagcucuuaguuuacacuuc

SEQ ID NO: 139618 - RNA, 23 nt, Human
guugcccaggcugaucuugaacu

SEQ ID NO: 139619 - RNA, 27 nt, Human
aggcccagagucuaagacugcagugag

SEQ ID NO: 139620 - RNA, 20 nt, Human
uugagucagugucuuacaug

SEQ ID NO: 139621 - RNA, 27 nt, Human
ccugcagcugaguucagcagaaaggag

SEQ ID NO: 139622 - RNA, 24 nt, Human
gagagaggaggaagagggagucug

SEQ ID NO: 139623 - RNA, 26 nt, Human
cccgucugcugaugugcccagccugu

SEQ ID NO: 139624 - RNA, 23 nt, Human
cagcaggccacuggggacagaag

SEQ ID NO: 139625 - RNA, 18 nt, Human
auuuggaaagaaaaagaa

SEQ ID NO: 139626 - RNA, 22 nt, Human
ucagaaauauauaggucccagg

SEQ ID NO: 139627 - RNA, 20 nt, Human
acaggcugcacaucucagua

SEQ ID NO: 139628 - RNA, 24 nt, Human
ucuccccucucuuucuaagagacc

SEQ ID NO: 139629 - RNA, 24 nt, Human
acauaucuccugaagauacuugaa

SEQ ID NO: 139630 - RNA, 26 nt, Human
uaaacaacagacuuacguuaaacuuc

SEQ ID NO: 139631 - RNA, 19 nt, Human
ugggaauauacacauauua

SEQ ID NO: 139632 - RNA, 22 nt, Human
gugaaguuuaacacaacugaac

SEQ ID NO: 139633 - RNA, 21 nt, Human
ucuguacugguucucuucuuu

SEQ ID NO: 139634 - RNA, 27 nt, Human
aguacuugaauaaguaugcagcagaac

SEQ ID NO: 139635 - RNA, 17 nt, Human
accugaagugaucaugu

SEQ ID NO: 139636 - RNA, 24 nt, Human
aagcaggcugccugguuuuuccca

SEQ ID NO: 139637 - RNA, 20 nt, Human
uuauggagaaauaauagaaa

SEQ ID NO: 139638 - RNA, 22 nt, Human
gaaaacugcagcccggccaggc

SEQ ID NO: 139639 - RNA, 27 nt, Human
uccuccagggagacuagguuauucucu

SEQ ID NO: 139640 - RNA, 27 nt, Human
ccauugcgcucuagccugggcaacaac

SEQ ID NO: 139641 - RNA, 21 nt, Human
gugcucuuccuaaaguuccuu

SEQ ID NO: 139642 - RNA, 29 nt, Human
uugcccaaaaggcuggagagggcagggag

SEQ ID NO: 139643 - RNA, 21 nt, Human
gcucuggaagcuuguggagaa

SEQ ID NO: 139644 - RNA, 24 nt, Human
ccugcguggucaacuccugucuuc

SEQ ID NO: 139645 - RNA, 26 nt, Human
cccuuccucucccccugucuguuucc

SEQ ID NO: 139646 - RNA, 26 nt, Human
ccccgucugcgccgcugugcuguugu

SEQ ID NO: 139647 - RNA, 25 nt, Human
uuuuacauuuucuuauuuuaacuac

SEQ ID NO: 139648 - RNA, 21 nt, Human
cugucucacaaauacaagcau

SEQ ID NO: 139649 - RNA, 19 nt, Human
ggcucucagcaccuaccuc

SEQ ID NO: 139650 - RNA, 18 nt, Human
aaaaacaaugugcugcug

SEQ ID NO: 139651 - RNA, 25 nt, Human
gcuccuccagcaucuguuucucccu

SEQ ID NO: 139652 - RNA, 22 nt, Human
auugcuugaaccugggaggugg

SEQ ID NO: 139653 - RNA, 25 nt, Human
uuguaauuucuuuugaaaaugacca

SEQ ID NO: 139654 - RNA, 24 nt, Human
cuccagccucacguucacuuaggc

SEQ ID NO: 139655 - RNA, 26 nt, Human
cugugggucccuggcaagugucuugu

SEQ ID NO: 139656 - RNA, 22 nt, Human
agccucccaaaaugcugggauu

SEQ ID NO: 139657 - RNA, 26 nt, Human
aggcuuucuucagaacugaacuagaa

SEQ ID NO: 139658 - RNA, 23 nt, Human
uuccauuuaauggggugcaccug

SEQ ID NO: 139659 - RNA, 23 nt, Human
cagugcagagauccuacuucucu

SEQ ID NO: 139660 - RNA, 22 nt, Human
ugcaggggacuucauuuccuuc

SEQ ID NO: 139661 - RNA, 22 nt, Human
gagaagggcaaaagcaaagaag

SEQ ID NO: 139662 - RNA, 23 nt, Human
ggcaggagaauugcuugaaccug

SEQ ID NO: 139663 - RNA, 23 nt, Human
uuuggcaugaaggauauggugcu

SEQ ID NO: 139664 - RNA, 28 nt, Human
uucaauuccauuauguuuuaauguuguc

SEQ ID NO: 139665 - RNA, 22 nt, Human
cacagaacuuugaaccuaggag

SEQ ID NO: 139666 - RNA, 21 nt, Human
aauugcugggauuacaggcau

SEQ ID NO: 139667 - RNA, 27 nt, Human
uuuauucuucuaauuaacagcuccuag

SEQ ID NO: 139668 - RNA, 21 nt, Human
gccaugcuccagcaaaaucaa

SEQ ID NO: 139669 - RNA, 23 nt, Human
uuccagaacccagccuccugggu

SEQ ID NO: 139670 - RNA, 21 nt, Human
ugggagguggagggccccuga

SEQ ID NO: 139671 - RNA, 19 nt, Human
uuuucccucuucacuuggu

SEQ ID NO: 139672 - RNA, 20 nt, Human
cuggaagucuguaucuugac

SEQ ID NO: 139673 - RNA, 27 nt, Human
ccaggagauggguccaggggucugucu

SEQ ID NO: 139674 - RNA, 25 nt, Human
cacacugaggaacggagaccuguga

SEQ ID NO: 139675 - RNA, 22 nt, Human
guggguuaucuuuuccaaggaa

SEQ ID NO: 139676 - RNA, 20 nt, Human
cagcauuuguccuuuuguga

SEQ ID NO: 139677 - RNA, 22 nt, Human
gccccagucauccugcccagcc

SEQ ID NO: 139678 - RNA, 23 nt, Human
aguuugcuccccuuugcuugaag

SEQ ID NO: 139679 - RNA, 25 nt, Human
ucuguuccuuuggcuuucucuugga

SEQ ID NO: 139680 - RNA, 21 nt, Human
acaggcaaugcuggcuguugg

SEQ ID NO: 139681 - RNA, 24 nt, Human
agccuguuuuuaacuuccuugcua

SEQ ID NO: 139682 - RNA, 20 nt, Human
gauauacuugguucucucca

SEQ ID NO: 139683 - RNA, 21 nt, Human
gcucuugaacuccugaccuca

SEQ ID NO: 139684 - RNA, 21 nt, Human
cugcagccucaaacuccuggg

SEQ ID NO: 139685 - RNA, 21 nt, Human
ugugcaucuuauuucugucaa

SEQ ID NO: 139686 - RNA, 23 nt, Human
ucucacaaaaaggcaaauauuga

SEQ ID NO: 139687 - RNA, 22 nt, Human
uggugcaugccuguaaucucgg

SEQ ID NO: 139688 - RNA, 28 nt, Human
aacaugauuucaaaaucaguuuuucaua

SEQ ID NO: 139689 - RNA, 20 nt, Human
caacaccauugaugccugcc

SEQ ID NO: 139690 - RNA, 23 nt, Human
augggcgcuggaugaaguggcac

SEQ ID NO: 139691 - RNA, 17 nt, Human
uuagacaaaucccacug

SEQ ID NO: 139692 - RNA, 23 nt, Human
ucauuguguuuuucaaagugauu

SEQ ID NO: 139693 - RNA, 27 nt, Human
uccuaaaacaugaaaauuaucucccuu

SEQ ID NO: 139694 - RNA, 25 nt, Human
ugcuccuccagccccagcugcccug

SEQ ID NO: 139695 - RNA, 23 nt, Human
gguuuacuauacaucagcauuuu

SEQ ID NO: 139696 - RNA, 20 nt, Human
acauuuggaaggcacugccu

SEQ ID NO: 139697 - RNA, 25 nt, Human
ccacuggaacucacaaaggucuccu

SEQ ID NO: 139698 - RNA, 24 nt, Human
ugccuuuccccucugccuguuucc

SEQ ID NO: 139699 - RNA, 25 nt, Human
agccuccugaguagcugggacugca

SEQ ID NO: 139700 - RNA, 23 nt, Human
ccaaucugcuuucugucucuaug

SEQ ID NO: 139701 - RNA, 25 nt, Human
cuucuagcuggcucucugcugccac

SEQ ID NO: 139702 - RNA, 26 nt, Human
gcuggcuggcugccuuuugcuguggg

SEQ ID NO: 139703 - RNA, 26 nt, Human
uguacagcuaagagaaaagcuuaaga

SEQ ID NO: 139704 - RNA, 23 nt, Human
gaguuugagcgaaucaaaugggc

SEQ ID NO: 139705 - RNA, 19 nt, Human
aacaacagcaagaaaaucu

SEQ ID NO: 139706 - RNA, 26 nt, Human
ggaggugggcuggcgcggagggaggg

SEQ ID NO: 139707 - RNA, 27 nt, Human
gaccgaggacacaguggagcccacgag

SEQ ID NO: 139708 - RNA, 22 nt, Human
ccuguccuucucucaccuccua

SEQ ID NO: 139709 - RNA, 19 nt, Human
agccuuucgggaggcugag

SEQ ID NO: 139710 - RNA, 27 nt, Human
ccccugccuugcuccccgaggccugcc

SEQ ID NO: 139711 - RNA, 18 nt, Human
auccucacgaccaccuca

SEQ ID NO: 139712 - RNA, 18 nt, Human
guccucacaaccaccuca

SEQ ID NO: 139713 - RNA, 27 nt, Human
ucaggugauccgcccgccucugccucc

SEQ ID NO: 139714 - RNA, 22 nt, Human
guucacugcaaccuccgccucc

SEQ ID NO: 139715 - RNA, 22 nt, Human
gggacucugagaacuccucauu

SEQ ID NO: 139716 - RNA, 22 nt, Human
gggaggggaagaaaaacucuau

SEQ ID NO: 139717 - RNA, 22 nt, Human
aaaacaaaaacaucaaugagua

SEQ ID NO: 139718 - RNA, 18 nt, Human
ucccuguggacucucuca

SEQ ID NO: 139719 - RNA, 19 nt, Human
ggcaugcaucuuuaauucc

SEQ ID NO: 139720 - RNA, 26 nt, Human
gcacccugcagccaccagcacugccu

SEQ ID NO: 139721 - RNA, 26 nt, Human
guccccugggcucaagucaagcaguc

SEQ ID NO: 139722 - RNA, 21 nt, Human
acauucccucacacaguacag

SEQ ID NO: 139723 - RNA, 22 nt, Human
auugcacuccaggcugggcagc

SEQ ID NO: 139724 - RNA, 22 nt, Human
cauaaagaccauguacauguau

SEQ ID NO: 139725 - RNA, 22 nt, Human
ugcagugaaccaagaucacacc

SEQ ID NO: 139726 - RNA, 23 nt, Human
ggaaggcugaggcaggaggauca

SEQ ID NO: 139727 - RNA, 27 nt, Human
ggaaguagaagucauauguugucuuug

SEQ ID NO: 139728 - RNA, 24 nt, Human
ggguccaccgucugucugcucccu

SEQ ID NO: 139729 - RNA, 21 nt, Human
ggcgauggugccuggucucug

SEQ ID NO: 139730 - RNA, 24 nt, Human
guggcccaggcugagagcagcagg

SEQ ID NO: 139731 - RNA, 30 nt, Human
uuaagauauuuggacuuccugcauggauau

SEQ ID NO: 139732 - RNA, 25 nt, Human
gcccaggcuggagugcauuggcgcg

SEQ ID NO: 139733 - RNA, 24 nt, Human
gaccaauucucuccaugacauguu

SEQ ID NO: 139734 - RNA, 21 nt, Human
cuucccuugcuaccacggccu

SEQ ID NO: 139735 - RNA, 20 nt, Human
ugcggggcuccagucaggcc

SEQ ID NO: 139736 - RNA, 26 nt, Human
cccagccuuguugagguucucuauug

SEQ ID NO: 139737 - RNA, 23 nt, Human
uucacucucugggggagugcagg

SEQ ID NO: 139738 - RNA, 24 nt, Human
gcaucuaaaccuuucuucuuuccc

SEQ ID NO: 139739 - RNA, 20 nt, Human
agcuggucaagguagaaaua

SEQ ID NO: 139740 - RNA, 24 nt, Human
aagagaaagaaaaccuggagcagc

SEQ ID NO: 139741 - RNA, 28 nt, Human
uuuacuuucccuucccccauaaguugga

SEQ ID NO: 139742 - RNA, 22 nt, Human
caugccccuuccuuccuucucc

SEQ ID NO: 139743 - RNA, 22 nt, Human
cuugcucacuggucccugccag

SEQ ID NO: 139744 - RNA, 26 nt, Human
ggagcuggagcaggcacuugcagccg

SEQ ID NO: 139745 - RNA, 24 nt, Human
agugauuuacaaaaagauuucuga

SEQ ID NO: 139746 - RNA, 21 nt, Human
aaugagccagauggaguacca

SEQ ID NO: 139747 - RNA, 25 nt, Human
uuuuugggagaaaacuucucacacu

SEQ ID NO: 139748 - RNA, 19 nt, Human
uggcucucuuuauuuuucu

SEQ ID NO: 139749 - RNA, 24 nt, Human
ccaugccaccaauuccacugcuac

SEQ ID NO: 139750 - RNA, 32 nt, Human
uccgaaugugcuccaggcgacaccauuugcca

SEQ ID NO: 139751 - RNA, 26 nt, Human
gccucggucacccugcacagcaggcc

SEQ ID NO: 139752 - RNA, 18 nt, Human
ucaugaacuucauuacuc

SEQ ID NO: 139753 - RNA, 24 nt, Human
aguucaaagaaucucuucuugccu

SEQ ID NO: 139754 - RNA, 21 nt, Human
ugccuguacucccagcacuuu

SEQ ID NO: 139755 - RNA, 22 nt, Human
uguugaccaggcuggagugaag

SEQ ID NO: 139756 - RNA, 25 nt, Human
cacuguacuccagccugaagagcga

SEQ ID NO: 139757 - RNA, 25 nt, Human
uaaagaauggcccuuguggauaagc

SEQ ID NO: 139758 - RNA, 21 nt, Human
aaucuaggccgggugcagugg

SEQ ID NO: 139759 - RNA, 21 nt, Human
ugccucuggcuuuccggucau

SEQ ID NO: 139760 - RNA, 18 nt, Human
gguggaggggccaccuca

SEQ ID NO: 139761 - RNA, 21 nt, Human
gacuauccccuuccucaucca

SEQ ID NO: 139762 - RNA, 27 nt, Human
gcacuuaaaagaaccacccacaccucu

SEQ ID NO: 139763 - RNA, 20 nt, Human
ugcccaggcuugaugggaua

SEQ ID NO: 139764 - RNA, 24 nt, Human
gcuuuaaaugccuuccuucucugc

SEQ ID NO: 139765 - RNA, 22 nt, Human
guaaagagcuuucucacaaaaa

SEQ ID NO: 139766 - RNA, 19 nt, Human
gacgacuuacagugacaaa

SEQ ID NO: 139767 - RNA, 22 nt, Human
gagaggggagugggaugccuuc

SEQ ID NO: 139768 - RNA, 22 nt, Human
uuuuaucuuaucuuauucucca

SEQ ID NO: 139769 - RNA, 22 nt, Human
ugcagugagccaagaucgugcc

SEQ ID NO: 139770 - RNA, 22 nt, Human
uguggugagccgagaucgcgcc

SEQ ID NO: 139771 - RNA, 22 nt, Human
ugcagugagcuaagaucgcgcc

SEQ ID NO: 139772 - RNA, 21 nt, Human
gggguccacucugacccuaga

SEQ ID NO: 139773 - RNA, 21 nt, Human
auguuuuucagccauugaaaa

SEQ ID NO: 139774 - RNA, 23 nt, Human
cucacacagauucaccuuuuuuc

SEQ ID NO: 139775 - RNA, 21 nt, Human
ugagccaagaucauaccacug

SEQ ID NO: 139776 - RNA, 23 nt, Human
agggcacauugcaaacugaaaua

SEQ ID NO: 139777 - RNA, 23 nt, Human
ccuuuugcuuugccuuguggaca

SEQ ID NO: 139778 - RNA, 23 nt, Human
ugcaaccuccaccucccaggcuc

SEQ ID NO: 139779 - RNA, 23 nt, Human
accuccccaggcucaccuugcca

SEQ ID NO: 139780 - RNA, 22 nt, Human
ugcauguaauccuagcacuuug

SEQ ID NO: 139781 - RNA, 23 nt, Human
aauagagacagggucucgcagug

SEQ ID NO: 139782 - RNA, 23 nt, Human
ccgggaggugcugccugccaggg

SEQ ID NO: 139783 - RNA, 24 nt, Human
ccuguucugccccagcuguuccuc

SEQ ID NO: 139784 - RNA, 21 nt, Human
cagccugggcgcaguggugcu

SEQ ID NO: 139785 - RNA, 20 nt, Human
augagccucaguacuggccu

SEQ ID NO: 139786 - RNA, 26 nt, Human
ggaggcaccuuaucagcagagcacuu

SEQ ID NO: 139787 - RNA, 18 nt, Human
aaacaaaaaaccaacucu

SEQ ID NO: 139788 - RNA, 25 nt, Human
aggaugugcggugcauaaaggggcu

SEQ ID NO: 139789 - RNA, 24 nt, Human
uggcagcagagccugggcagguga

SEQ ID NO: 139790 - RNA, 18 nt, Human
acagcuuucaagugccuu

SEQ ID NO: 139791 - RNA, 21 nt, Human
guugaccgccuuuucccauug

SEQ ID NO: 139792 - RNA, 21 nt, Human
agaagcagcauuuugucuuau

SEQ ID NO: 139793 - RNA, 23 nt, Human
ucuccuagugagugugcugacuu

SEQ ID NO: 139794 - RNA, 25 nt, Human
ggcucacugaaggcucgaaggcacu

SEQ ID NO: 139795 - RNA, 22 nt, Human
gagggaggggaaaggcaaaugc

SEQ ID NO: 139796 - RNA, 23 nt, Human
aagaaauaauauauaaacuccuu

SEQ ID NO: 139797 - RNA, 27 nt, Human
uccagaagaauauucaggacuuaacgg

SEQ ID NO: 139798 - RNA, 23 nt, Human
aaguguucagaacaacugcaaag

SEQ ID NO: 139799 - RNA, 22 nt, Human
uggccagcucacgccugcuucc

SEQ ID NO: 139800 - RNA, 25 nt, Human
aagccacauggugacuuuugaaaag

SEQ ID NO: 139801 - RNA, 22 nt, Human
uguuuagaaacugcugcaagac

SEQ ID NO: 139802 - RNA, 18 nt, Human
ugggggugggugggugga

SEQ ID NO: 139803 - RNA, 23 nt, Human
gccucgacucccuuucaccaaca

SEQ ID NO: 139804 - RNA, 20 nt, Human
agguaaagcaguugagauuc

SEQ ID NO: 139805 - RNA, 27 nt, Human
uguauguuuuuauguggaugaagagca

SEQ ID NO: 139806 - RNA, 22 nt, Human
cccuacucuccagaauccaggg

SEQ ID NO: 139807 - RNA, 21 nt, Human
gcaggcugcgggcaguggcac

SEQ ID NO: 139808 - RNA, 26 nt, Human
aaacugacagaggagggcgugacuca

SEQ ID NO: 139809 - RNA, 22 nt, Human
agcauuuugucauauccccucu

SEQ ID NO: 139810 - RNA, 27 nt, Human
aaccaucagaauucagaaucuauagug

SEQ ID NO: 139811 - RNA, 23 nt, Human
auacagugguauugcuaguuuaa

SEQ ID NO: 139812 - RNA, 25 nt, Human
cacaaggaauguagacugaauggug

SEQ ID NO: 139813 - RNA, 22 nt, Human
gguugacugcauuucuagacuc

SEQ ID NO: 139814 - RNA, 24 nt, Human
ggaucuuuuucugccccugcucca

SEQ ID NO: 139815 - RNA, 30 nt, Human
ugggagguggaggaggguugcagcucccac

SEQ ID NO: 139816 - RNA, 22 nt, Human
agaggaaguguggggaggaagg

SEQ ID NO: 139817 - RNA, 20 nt, Human
ggcagguccugcccaugugu

SEQ ID NO: 139818 - RNA, 23 nt, Human
ugccuguaaucccagcuacucau

SEQ ID NO: 139819 - RNA, 21 nt, Human
cgcucccgcgcugcugcucca

SEQ ID NO: 139820 - RNA, 22 nt, Human
aagggagggggaaacauacauu

SEQ ID NO: 139821 - RNA, 22 nt, Human
acaaucagaaaucccaugugcc

SEQ ID NO: 139822 - RNA, 22 nt, Human
gagagagaauucuuucaaguga

SEQ ID NO: 139823 - RNA, 21 nt, Human
gcugacugcccagagacucag

SEQ ID NO: 139824 - RNA, 23 nt, Human
ucuucauuuuuccuccugucugc

SEQ ID NO: 139825 - RNA, 20 nt, Human
ucuuuuagcagcacuucugc

SEQ ID NO: 139826 - RNA, 25 nt, Human
aggggaggggguccgugguagaggc

SEQ ID NO: 139827 - RNA, 24 nt, Human
guggauacggaaaugguuaaguac

SEQ ID NO: 139828 - RNA, 21 nt, Human
cccagcaccugguguuugcca

SEQ ID NO: 139829 - RNA, 23 nt, Human
ucuucaugccuugaaauuuuggg

SEQ ID NO: 139830 - RNA, 18 nt, Human
ucaucgccccucugugaa

SEQ ID NO: 139831 - RNA, 27 nt, Human
ugacucagacagguacuauucguaggc

SEQ ID NO: 139832 - RNA, 19 nt, Human
cucuccucucguuagugcc

SEQ ID NO: 139833 - RNA, 22 nt, Human
ccugcugcguccccacucccuu

SEQ ID NO: 139834 - RNA, 26 nt, Human
ccuuucucccucgcguuaggcaggug

SEQ ID NO: 139835 - RNA, 19 nt, Human
gcgccuggcccuguauuuu

SEQ ID NO: 139836 - RNA, 22 nt, Human
ccaggcucucccucucugcacc

SEQ ID NO: 139837 - RNA, 26 nt, Human
uaggagaccccuaaguuguucucagg

SEQ ID NO: 139838 - RNA, 24 nt, Human
ccugggcuaggggacaucagaggu

SEQ ID NO: 139839 - RNA, 23 nt, Human
ccaacuuuuucauucccugcccc

SEQ ID NO: 139840 - RNA, 22 nt, Human
gccuguaagcccagcacuuugg

SEQ ID NO: 139841 - RNA, 22 nt, Human
uccuguaaucccagcacuuugg

SEQ ID NO: 139842 - RNA, 24 nt, Human
cgcugucuccuuuggcugaggaga

SEQ ID NO: 139843 - RNA, 19 nt, Human
gccuaaaaaugauucuuug

SEQ ID NO: 139844 - RNA, 28 nt, Human
guaagaugcuuagggugccuggccagga

SEQ ID NO: 139845 - RNA, 21 nt, Human
acaaaggcuuaaguuugaaag

SEQ ID NO: 139846 - RNA, 27 nt, Human
ggaggcugaggcaagagaaucgcuuga

SEQ ID NO: 139847 - RNA, 25 nt, Human
ucucagcaacaguggaauucaccuu

SEQ ID NO: 139848 - RNA, 21 nt, Human
ucuccaccuuuuucuuaugag

SEQ ID NO: 139849 - RNA, 19 nt, Human
cccaauccccaggucucua

SEQ ID NO: 139850 - RNA, 32 nt, Human
ccggcuccguacuccggccccggccugcgccc

SEQ ID NO: 139851 - RNA, 20 nt, Human
ucuuccuauuugccaugggc

SEQ ID NO: 139852 - RNA, 23 nt, Human
agugcugugcugcccauuugggc

SEQ ID NO: 139853 - RNA, 21 nt, Human
gccacugcaauucagccuggg

SEQ ID NO: 139854 - RNA, 23 nt, Human
ccaagucccaccaccgagcccac

SEQ ID NO: 139855 - RNA, 22 nt, Human
ugcuagggaggguaaagggaga

SEQ ID NO: 139856 - RNA, 22 nt, Human
caaccuggagugcaguggugcg

SEQ ID NO: 139857 - RNA, 22 nt, Human
agagccgggaggcagagggagu

SEQ ID NO: 139858 - RNA, 24 nt, Human
cucuuccacugucguccuuccuca

SEQ ID NO: 139859 - RNA, 25 nt, Human
uagcauacaauuuucagauauugcc

SEQ ID NO: 139860 - RNA, 26 nt, Human
cugggugcugcacagacuugucaagg

SEQ ID NO: 139861 - RNA, 24 nt, Human
cuguaaucccagcuauucaggagg

SEQ ID NO: 139862 - RNA, 21 nt, Human
ggucacugaaccacugcuucu

SEQ ID NO: 139863 - RNA, 22 nt, Human
uucaguuaaguugcuguaagca

SEQ ID NO: 139864 - RNA, 20 nt, Human
ugcuuagaaucuauuauuua

SEQ ID NO: 139865 - RNA, 21 nt, Human
cuucccccacagauacacauc

SEQ ID NO: 139866 - RNA, 21 nt, Human
aaggaaagaggaagugcuaga

SEQ ID NO: 139867 - RNA, 25 nt, Human
cacugccuccaggguucaagcgauu

SEQ ID NO: 139868 - RNA, 25 nt, Human
uggucugcuuucuuccaaguuugcc

SEQ ID NO: 139869 - RNA, 23 nt, Human
guggaguccacagucccucccug

SEQ ID NO: 139870 - RNA, 22 nt, Human
cagaaggcagagguuguaguga

SEQ ID NO: 139871 - RNA, 27 nt, Human
gacuggguggggaggguguugaauaaa

SEQ ID NO: 139872 - RNA, 20 nt, Human
uuucugcugcuguuccuaga

SEQ ID NO: 139873 - RNA, 22 nt, Human
caggcuggagugcaguggcacg

SEQ ID NO: 139874 - RNA, 22 nt, Human
caggcuggaguguaguggcaug

SEQ ID NO: 139875 - RNA, 24 nt, Human
cgucauuccucuccuuccuugcug

SEQ ID NO: 139876 - RNA, 22 nt, Human
cucccacagcuguggcugcagg

SEQ ID NO: 139877 - RNA, 22 nt, Human
uaggccaccuccaaggacucua

SEQ ID NO: 139878 - RNA, 27 nt, Human
cucuugccucugcuuucccccacucug

SEQ ID NO: 139879 - RNA, 21 nt, Human
ucaggaaaucaaauaugcaaa

SEQ ID NO: 139880 - RNA, 20 nt, Human
ugccaucucaaagaggagca

SEQ ID NO: 139881 - RNA, 21 nt, Human
uccccaggcuggguguggagg

SEQ ID NO: 139882 - RNA, 25 nt, Human
ucaugccacugcacuccacucuggg

SEQ ID NO: 139883 - RNA, 23 nt, Human
cugccucugcacgccaccccgug

SEQ ID NO: 139884 - RNA, 22 nt, Human
ugcaaccucugccucccggguu

SEQ ID NO: 139885 - RNA, 22 nt, Human
ucccugacagcccaucuuccua

SEQ ID NO: 139886 - RNA, 24 nt, Human
cacagcccugagcucuuuacggga

SEQ ID NO: 139887 - RNA, 21 nt, Human
acuccuuuacugcagccuggg

SEQ ID NO: 139888 - RNA, 22 nt, Human
gagccagccccuuucugcucca

SEQ ID NO: 139889 - RNA, 22 nt, Human
ccauuguacuccagccugggca

SEQ ID NO: 139890 - RNA, 20 nt, Human
accacccuccaugucaggua

SEQ ID NO: 139891 - RNA, 29 nt, Human
ucauguucagucuucaggauaucacacca

SEQ ID NO: 139892 - RNA, 17 nt, Human
gcgugagcaagcaagcc

SEQ ID NO: 139893 - RNA, 26 nt, Human
uuucagccucagaggucacagugggu

SEQ ID NO: 139894 - RNA, 24 nt, Human
gcuuugucuccucuauccugggcu

SEQ ID NO: 139895 - RNA, 22 nt, Human
cuggggcaaaaauauaacucua

SEQ ID NO: 139896 - RNA, 21 nt, Human
gcugccucuuuccuccucacu

SEQ ID NO: 139897 - RNA, 23 nt, Human
cuuuccucugcacgcucaaugcc

SEQ ID NO: 139898 - RNA, 26 nt, Human
ugcuccaguugcggucaucaugacua

SEQ ID NO: 139899 - RNA, 24 nt, Human
cugagggagacaacggcagaggga

SEQ ID NO: 139900 - RNA, 21 nt, Human
cuggcuguccugguucacuca

SEQ ID NO: 139901 - RNA, 22 nt, Human
aaggucuaggaaagccucccuc

SEQ ID NO: 139902 - RNA, 26 nt, Human
ugaaggagaaggaggguaguguuuug

SEQ ID NO: 139903 - RNA, 22 nt, Human
ggagcacgcgucccgcucgggc

SEQ ID NO: 139904 - RNA, 17 nt, Human
uacauacauuauuuucu

SEQ ID NO: 139905 - RNA, 22 nt, Human
ccacacguacacacagaugcac

SEQ ID NO: 139906 - RNA, 25 nt, Human
cagaaauugaauuaccaucuguauu

SEQ ID NO: 139907 - RNA, 23 nt, Human
gcucugccaccaguaacagucaa

SEQ ID NO: 139908 - RNA, 22 nt, Human
cuccucacugccccacugugcu

SEQ ID NO: 139909 - RNA, 20 nt, Human
gcuaauuuugucaagcacag

SEQ ID NO: 139910 - RNA, 23 nt, Human
gacaacaaaaaugcugccagucc

SEQ ID NO: 139911 - RNA, 25 nt, Human
gggauuacaaguaauacaaaauaca

SEQ ID NO: 139912 - RNA, 26 nt, Human
cgucugggcuggagcgcaguccccag

SEQ ID NO: 139913 - RNA, 20 nt, Human
cuucacauaaaggaacaugg

SEQ ID NO: 139914 - RNA, 20 nt, Human
ucuguucccuggcugugcca

SEQ ID NO: 139915 - RNA, 25 nt, Human
aaaugccacacaucacccuuaccau

SEQ ID NO: 139916 - RNA, 25 nt, Human
guggauaucugccuuccugcugcaa

SEQ ID NO: 139917 - RNA, 26 nt, Human
guuacucccuuccuuuggucuucacu

SEQ ID NO: 139918 - RNA, 27 nt, Human
ggaggcugaggcaagagaauugcuuga

SEQ ID NO: 139919 - RNA, 21 nt, Human
aauuuucuauguguuguguuu

SEQ ID NO: 139920 - RNA, 29 nt, Human
cuuccucaucugugccugucuguccaacc

SEQ ID NO: 139921 - RNA, 26 nt, Human
uccaaauuggagucugugcuuccuuc

SEQ ID NO: 139922 - RNA, 22 nt, Human
ugggcacucgguuaucuuuuaa

SEQ ID NO: 139923 - RNA, 23 nt, Human
cucuggccuaggcuggcuccagu

SEQ ID NO: 139924 - RNA, 23 nt, Human
gggccuuuuucacuuagaagcug

SEQ ID NO: 139925 - RNA, 24 nt, Human
aggcugagaagucuugcagucugc

SEQ ID NO: 139926 - RNA, 20 nt, Human
acugggcuuaucacugggaa

SEQ ID NO: 139927 - RNA, 27 nt, Human
ugucagcaggcugcagggagugcacac

SEQ ID NO: 139928 - RNA, 22 nt, Human
uucuccaggauggcagaggcgg

SEQ ID NO: 139929 - RNA, 22 nt, Human
acugugaucacagaaaaauuaa

SEQ ID NO: 139930 - RNA, 22 nt, Human
ccuuucuccccuuuggaugguu

SEQ ID NO: 139931 - RNA, 22 nt, Human
ggcucuagcccaggcuuugucc

SEQ ID NO: 139932 - RNA, 31 nt, Human
uagaacuucacuuauuugagggguaauuuuu

SEQ ID NO: 139933 - RNA, 22 nt, Human
agccuccaccccuuccugaaga

SEQ ID NO: 139934 - RNA, 20 nt, Human
guacagacuucuugguaccc

SEQ ID NO: 139935 - RNA, 27 nt, Human
uguggguggacgugguuggugauuggc

SEQ ID NO: 139936 - RNA, 22 nt, Human
cugucaccaaggaaacgcuacc

SEQ ID NO: 139937 - RNA, 23 nt, Human
gucaagucugcuggaaugcagga

SEQ ID NO: 139938 - RNA, 21 nt, Human
gccuacaucuucucucuuccc

SEQ ID NO: 139939 - RNA, 22 nt, Human
aguaccuggugcuagagaauag

SEQ ID NO: 139940 - RNA, 22 nt, Human
cacagccgccgccgcuggccag

SEQ ID NO: 139941 - RNA, 26 nt, Human
gauuguuugccuucuuauuguuggau

SEQ ID NO: 139942 - RNA, 22 nt, Human
ucagugucuuuucagcacuuug

SEQ ID NO: 139943 - RNA, 26 nt, Human
cugggagggaggagcuuggugcagcu

SEQ ID NO: 139944 - RNA, 25 nt, Human
ucuuaacauugcagcuuucucucca

SEQ ID NO: 139945 - RNA, 23 nt, Human
aggagcagcagaggaugugguga

SEQ ID NO: 139946 - RNA, 23 nt, Human
gaccucucaaggcccugaccuca

SEQ ID NO: 139947 - RNA, 24 nt, Human
ucucuaccgaacuucccaggauuu

SEQ ID NO: 139948 - RNA, 28 nt, Human
ucuuuuaagaaaacauacacuuggauuu

SEQ ID NO: 139949 - RNA, 28 nt, Human
cucugcgagguguuuacacuggaggugg

SEQ ID NO: 139950 - RNA, 27 nt, Human
guugccaaggcuggagugcaggccgcg

SEQ ID NO: 139951 - RNA, 21 nt, Human
cuucauuuucaggaaaucuac

SEQ ID NO: 139952 - RNA, 22 nt, Human
ccgaguagcugggacuacaggc

SEQ ID NO: 139953 - RNA, 24 nt, Human
cucuagucaguccagcucaucugc

SEQ ID NO: 139954 - RNA, 27 nt, Human
ugccuguaguuccagcuacuugggagg

SEQ ID NO: 139955 - RNA, 25 nt, Human
ggugcccucacaggccaauagggaa

SEQ ID NO: 139956 - RNA, 21 nt, Human
ccucgagaugcgccaccuccc

SEQ ID NO: 139957 - RNA, 21 nt, Human
ucuagaaacaggaaacaccgu

SEQ ID NO: 139958 - RNA, 23 nt, Human
aguuugccuggugcaguggcuca

SEQ ID NO: 139959 - RNA, 22 nt, Human
cucagaucuuacuugguaguga

SEQ ID NO: 139960 - RNA, 28 nt, Human
ccuggagucugcagaccucagagagguc

SEQ ID NO: 139961 - RNA, 20 nt, Human
uccugcauuguucuuugcca

SEQ ID NO: 139962 - RNA, 20 nt, Human
ggcuuuggggucagcuacac

SEQ ID NO: 139963 - RNA, 19 nt, Human
ugcugggagaggaugagga

SEQ ID NO: 139964 - RNA, 26 nt, Human
ccagugcuccagccggugugaggaca

SEQ ID NO: 139965 - RNA, 21 nt, Human
aagcucacugugccucuuguu

SEQ ID NO: 139966 - RNA, 20 nt, Human
uuucauggaggccaggacag

SEQ ID NO: 139967 - RNA, 23 nt, Human
ccaauuuggcugggauuauucaa

SEQ ID NO: 139968 - RNA, 25 nt, Human
agggaaagcaagaaggcuggaggga

SEQ ID NO: 139969 - RNA, 20 nt, Human
uacaucuugacccuuuucca

SEQ ID NO: 139970 - RNA, 22 nt, Human
cacagccggucucucugccagg

SEQ ID NO: 139971 - RNA, 27 nt, Human
ugugguuaggcuugguuagagugcagc

SEQ ID NO: 139972 - RNA, 18 nt, Human
cuggcagcagcauuguga

SEQ ID NO: 139973 - RNA, 20 nt, Human
guuguuugggagagugcagu

SEQ ID NO: 139974 - RNA, 26 nt, Human
ccaggccaagaccacagcucugugau

SEQ ID NO: 139975 - RNA, 21 nt, Human
ucuucccaggauaacugaagu

SEQ ID NO: 139976 - RNA, 21 nt, Human
gccacugcgccacugccaucg

SEQ ID NO: 139977 - RNA, 26 nt, Human
uugggcagaggaagcugugcaacggg

SEQ ID NO: 139978 - RNA, 22 nt, Human
gccucaggaagcagcugggccc

SEQ ID NO: 139979 - RNA, 22 nt, Human
gccuaagcuggagugugguggc

SEQ ID NO: 139980 - RNA, 27 nt, Human
cugaguaugcaauaaagaugugguggc

SEQ ID NO: 139981 - RNA, 26 nt, Human
gcaacuuggagauuuugcuaauacau

SEQ ID NO: 139982 - RNA, 21 nt, Human
uggacaaaagcacauaauucu

SEQ ID NO: 139983 - RNA, 26 nt, Human
ucuccugcccggccucggaaccagcu

SEQ ID NO: 139984 - RNA, 24 nt, Human
guccaacccagccugagugcacca

SEQ ID NO: 139985 - RNA, 29 nt, Human
guucuccuaaacuuuaauaaaauguaucu

SEQ ID NO: 139986 - RNA, 27 nt, Human
cuguaaauaauuuucuccuuuuuucuc

SEQ ID NO: 139987 - RNA, 24 nt, Human
gugaccucacagcugccggaacau

SEQ ID NO: 139988 - RNA, 18 nt, Human
gagcagucuuccauucca

SEQ ID NO: 139989 - RNA, 23 nt, Human
aaauaaauaaauaaaucuggguc

SEQ ID NO: 139990 - RNA, 20 nt, Human
aucuaucuuccaaaugcaau

SEQ ID NO: 139991 - RNA, 27 nt, Human
ggggcagcuguggccuaggcuaccuca

SEQ ID NO: 139992 - RNA, 21 nt, Human
aaccuguccuggaauucuacc

SEQ ID NO: 139993 - RNA, 26 nt, Human
caaaacaaugguguggugaaugugug

SEQ ID NO: 139994 - RNA, 20 nt, Human
cuggcugcuaacaagucacc

SEQ ID NO: 139995 - RNA, 21 nt, Human
ggagagggugugagggcagau

SEQ ID NO: 139996 - RNA, 20 nt, Human
gacucuggcucaucuagucc

SEQ ID NO: 139997 - RNA, 25 nt, Human
gggacccccucaccauccagugggc

SEQ ID NO: 139998 - RNA, 25 nt, Human
agguuugcuacacacagccccggac

SEQ ID NO: 139999 - RNA, 24 nt, Human
cccaacucgucugccguccagaaa

SEQ ID NO: 140000 - RNA, 23 nt, Human
cugcuuuggaaagucauggaggu

SEQ ID NO: 140001 - RNA, 22 nt, Human
uaacacaugaauuucugccaua

SEQ ID NO: 140002 - RNA, 22 nt, Human
ggcagguucugccuccucucug

SEQ ID NO: 140003 - RNA, 21 nt, Human
aaacaaagaguucaagaaaua

SEQ ID NO: 140004 - RNA, 20 nt, Human
cuaagaugcucuaucuugcu

SEQ ID NO: 140005 - RNA, 20 nt, Human
auaauuauaauguaucugua

SEQ ID NO: 140006 - RNA, 20 nt, Human
uacuaguugauuucugcuua

SEQ ID NO: 140007 - RNA, 23 nt, Human
uucccaccaucugauuaaaacaa

SEQ ID NO: 140008 - RNA, 24 nt, Human
aggccuuacagaccacacugcagg

SEQ ID NO: 140009 - RNA, 23 nt, Human
aauuccuugagucuaaggcacag

SEQ ID NO: 140010 - RNA, 26 nt, Human
gcacagccuguccugggcccagcccu

SEQ ID NO: 140011 - RNA, 21 nt, Human
uggaggccaggauggagaauu

SEQ ID NO: 140012 - RNA, 22 nt, Human
ccccaggucuuccugcuuucca

SEQ ID NO: 140013 - RNA, 24 nt, Human
ugguuaugccuccucgauugcucc

SEQ ID NO: 140014 - RNA, 26 nt, Human
agacuugccuuacccugggcugaucu

SEQ ID NO: 140015 - RNA, 30 nt, Human
cuccaggagucucaucagcaaaccgcugac

SEQ ID NO: 140016 - RNA, 19 nt, Human
guauacacagggaggccag

SEQ ID NO: 140017 - RNA, 26 nt, Human
ucuuucuccucgcccgcuccccuggg

SEQ ID NO: 140018 - RNA, 17 nt, Human
cuguggcugggaaggga

SEQ ID NO: 140019 - RNA, 24 nt, Human
uguaacaaaagggcuuauucuucc

SEQ ID NO: 140020 - RNA, 24 nt, Human
ggggagaggcauggagaagaaacu

SEQ ID NO: 140021 - RNA, 23 nt, Human
accuccuauauuuccauauugug

SEQ ID NO: 140022 - RNA, 20 nt, Human
gcagaauaaaugagaaaaau

SEQ ID NO: 140023 - RNA, 21 nt, Human
cucccaggcuggagugcuaug

SEQ ID NO: 140024 - RNA, 21 nt, Human
cacccaggcuggagugcaaug

SEQ ID NO: 140025 - RNA, 21 nt, Human
cacccaggcuagagugcagug

SEQ ID NO: 140026 - RNA, 28 nt, Human
gagaagccucuuuccgagucgaccuccc

SEQ ID NO: 140027 - RNA, 21 nt, Human
caggugcauagucaaauccag

SEQ ID NO: 140028 - RNA, 21 nt, Human
ugcagcaagggcagggccaca

SEQ ID NO: 140029 - RNA, 25 nt, Human
aaauguaucuuucaacuguuuaguu

SEQ ID NO: 140030 - RNA, 23 nt, Human
cuccacacccucucccaggaccc

SEQ ID NO: 140031 - RNA, 27 nt, Human
cccagccgguaucccaggucucccuuc

SEQ ID NO: 140032 - RNA, 27 nt, Human
ggcuguacugcuauucuuacugcugcu

SEQ ID NO: 140033 - RNA, 22 nt, Human
aaggcaagagaaacauucuuuc

SEQ ID NO: 140034 - RNA, 22 nt, Human
acagagcgggacagaauggaua

SEQ ID NO: 140035 - RNA, 26 nt, Human
cuccacccugccguccugcgggagcc

SEQ ID NO: 140036 - RNA, 20 nt, Human
cuucacuugcuggagugcca

SEQ ID NO: 140037 - RNA, 27 nt, Human
ucuucuuuguggucuuuuuccugaaag

SEQ ID NO: 140038 - RNA, 19 nt, Human
uuuucugcuuuauuuugcu

SEQ ID NO: 140039 - RNA, 23 nt, Human
agggaggcauggagugccaugga

SEQ ID NO: 140040 - RNA, 23 nt, Human
gcauuagucauuuacaacaaaua

SEQ ID NO: 140041 - RNA, 21 nt, Human
acgucacaaccucugaucuca

SEQ ID NO: 140042 - RNA, 23 nt, Human
caugccuauaaucccagcuacuc

SEQ ID NO: 140043 - RNA, 21 nt, Human
cucugugagcggcggguggca

SEQ ID NO: 140044 - RNA, 26 nt, Human
gggaggcuggaguuggggcagaggag

SEQ ID NO: 140045 - RNA, 24 nt, Human
gcagagaccucaucagcagaccaa

SEQ ID NO: 140046 - RNA, 21 nt, Human
ggacaaggagcuuccgucugg

SEQ ID NO: 140047 - RNA, 23 nt, Human
ggcgugcucaccguaacaccacg

SEQ ID NO: 140048 - RNA, 22 nt, Human
cugggucuggaaaaaacugauc

SEQ ID NO: 140049 - RNA, 22 nt, Human
ggaguucugacuuucugggauu

SEQ ID NO: 140050 - RNA, 21 nt, Human
gagagugaaauggacguaaga

SEQ ID NO: 140051 - RNA, 22 nt, Human
cauugcauuccagccuaggcaa

SEQ ID NO: 140052 - RNA, 25 nt, Human
acacuaccugggcugggcccugcag

SEQ ID NO: 140053 - RNA, 22 nt, Human
gcuugaaaucccagucuccugg

SEQ ID NO: 140054 - RNA, 22 nt, Human
gggccuugagcagaauugagaa

SEQ ID NO: 140055 - RNA, 22 nt, Human
agaacaauggagauaucaguua

SEQ ID NO: 140056 - RNA, 18 nt, Human
ccaacuuguccuuuugua

SEQ ID NO: 140057 - RNA, 21 nt, Human
gaguuggcagagaaacugaga

SEQ ID NO: 140058 - RNA, 22 nt, Human
gacuacaggcaugcaccaccau

SEQ ID NO: 140059 - RNA, 22 nt, Human
aacuguuacaacuuguauuucc

SEQ ID NO: 140060 - RNA, 22 nt, Human
ugucacccagacuggaaugcag

SEQ ID NO: 140061 - RNA, 24 nt, Human
auugagucuccacuccacaagcac

SEQ ID NO: 140062 - RNA, 18 nt, Human
cuuuuccuucacuuacac

SEQ ID NO: 140063 - RNA, 26 nt, Human
uuccuguaacaucugcugaacgggcc

SEQ ID NO: 140064 - RNA, 22 nt, Human
ugcaaccucugccccccggguu

SEQ ID NO: 140065 - RNA, 22 nt, Human
ugcaaucucugccucccggguu

SEQ ID NO: 140066 - RNA, 30 nt, Human
cucuccaagccuccucaccccuaucuucau

SEQ ID NO: 140067 - RNA, 23 nt, Human
accccuguauuucacgcagcucu

SEQ ID NO: 140068 - RNA, 21 nt, Human
aaauccuaguaugccaaaaau

SEQ ID NO: 140069 - RNA, 20 nt, Human
aggcugagaggagagagacu

SEQ ID NO: 140070 - RNA, 24 nt, Human
ccugccucugugugcgugcaugug

SEQ ID NO: 140071 - RNA, 29 nt, Human
ggagggcagugcgcggggagccacggcgg

SEQ ID NO: 140072 - RNA, 22 nt, Human
uuguauuguuuuauacugugac

SEQ ID NO: 140073 - RNA, 29 nt, Human
cccuuuuuuguuccccuccaggaugcugc

SEQ ID NO: 140074 - RNA, 21 nt, Human
auuuggaaaaagagagggagg

SEQ ID NO: 140075 - RNA, 23 nt, Human
cgcucugcuccuggcuaccccag

SEQ ID NO: 140076 - RNA, 21 nt, Human
ggaaaaaguaggagaggcaga

SEQ ID NO: 140077 - RNA, 23 nt, Human
ccuuuagaacaggguuucucagc

SEQ ID NO: 140078 - RNA, 23 nt, Human
aaguaacaucuaaauaaaauuac

SEQ ID NO: 140079 - RNA, 21 nt, Human
uuucauuucaggugcauugga

SEQ ID NO: 140080 - RNA, 20 nt, Human
caaugccacaccugaagcac

SEQ ID NO: 140081 - RNA, 22 nt, Human
cgcgcuugugaucccagcacuu

SEQ ID NO: 140082 - RNA, 22 nt, Human
cacgcuuguaaucccagcacuu

SEQ ID NO: 140083 - RNA, 22 nt, Human
cacgccuguaaucucagcacuu

SEQ ID NO: 140084 - RNA, 23 nt, Human
cccagaagcagcaguggcagcuu

SEQ ID NO: 140085 - RNA, 26 nt, Human
cggaggcggaggcuugggugcguuca

SEQ ID NO: 140086 - RNA, 21 nt, Human
cagcuucguuguucccucugg

SEQ ID NO: 140087 - RNA, 22 nt, Human
aagucaaacuuggauacuugga

SEQ ID NO: 140088 - RNA, 24 nt, Human
ccugcucuuuccucccauggggcc

SEQ ID NO: 140089 - RNA, 21 nt, Human
guuagugcuuaaaagggggua

SEQ ID NO: 140090 - RNA, 22 nt, Human
caggcuggagugcaguggugca

SEQ ID NO: 140091 - RNA, 22 nt, Human
caggcuggagugcgguggugcg

SEQ ID NO: 140092 - RNA, 27 nt, Human
uacagaagguuuugaaauuaugcaggc

SEQ ID NO: 140093 - RNA, 20 nt, Human
gaccagucacagccauuuca

SEQ ID NO: 140094 - RNA, 22 nt, Human
gcugcccaggcuagagugcagu

SEQ ID NO: 140095 - RNA, 21 nt, Human
uggugaagccauagaaaaguu

SEQ ID NO: 140096 - RNA, 20 nt, Human
gccaaagugcauagucugag

SEQ ID NO: 140097 - RNA, 20 nt, Human
cgcaucccaagagcugcagu

SEQ ID NO: 140098 - RNA, 27 nt, Human
aaaccuacaggguggcccccugugcca

SEQ ID NO: 140099 - RNA, 20 nt, Human
ccugucucucccccgcugcc

SEQ ID NO: 140100 - RNA, 21 nt, Human
cccagcaccucagccugcaca

SEQ ID NO: 140101 - RNA, 27 nt, Human
uacugggcaucuccugagccuaggcaa

SEQ ID NO: 140102 - RNA, 21 nt, Human
cuaccucucugauuuuguuuc

SEQ ID NO: 140103 - RNA, 27 nt, Human
uuuccaccugggaauuucuggugccau

SEQ ID NO: 140104 - RNA, 22 nt, Human
ccugcagcugcagacaucugcu

SEQ ID NO: 140105 - RNA, 24 nt, Human
caggggcuaggaauuuagaaaaua

SEQ ID NO: 140106 - RNA, 20 nt, Human
gcuggcaguggacauuauuc

SEQ ID NO: 140107 - RNA, 26 nt, Human
gccuccgagcugcaaggagggugcgc

SEQ ID NO: 140108 - RNA, 20 nt, Human
ccuguagguggccccccugg

SEQ ID NO: 140109 - RNA, 22 nt, Human
augggaaaaggagccucuaccu

SEQ ID NO: 140110 - RNA, 23 nt, Human
guuuuccacaagacugaacaacg

SEQ ID NO: 140111 - RNA, 18 nt, Human
cugcugcccaccucucuc

SEQ ID NO: 140112 - RNA, 23 nt, Human
uagaaagaaguucagccgcaccc

SEQ ID NO: 140113 - RNA, 26 nt, Human
acucacugccccgucuguccaaggcc

SEQ ID NO: 140114 - RNA, 23 nt, Human
agagguggggagguggcgaggau

SEQ ID NO: 140115 - RNA, 26 nt, Human
uguggccugggcaagauaacgcacuu

SEQ ID NO: 140116 - RNA, 24 nt, Human
auuucucauuuagaaacagguucc

SEQ ID NO: 140117 - RNA, 25 nt, Human
augugggcuuccuggagcagaagca

SEQ ID NO: 140118 - RNA, 24 nt, Human
uagcacggacauggucuguccuga

SEQ ID NO: 140119 - RNA, 21 nt, Human
uaaguuuggccaacaaggugg

SEQ ID NO: 140120 - RNA, 17 nt, Human
gacucacucuccaucuc

SEQ ID NO: 140121 - RNA, 20 nt, Human
gccugggccgcacagcuggu

SEQ ID NO: 140122 - RNA, 22 nt, Human
aaaauugaggccaagggccaag

SEQ ID NO: 140123 - RNA, 20 nt, Human
ggaggagaagaaaauguucu

SEQ ID NO: 140124 - RNA, 19 nt, Human
agugcagggcagaggugag

SEQ ID NO: 140125 - RNA, 23 nt, Human
cacgagugagucggccuccagag

SEQ ID NO: 140126 - RNA, 26 nt, Human
ucuguucccuguucaggguccccugc

SEQ ID NO: 140127 - RNA, 18 nt, Human
aacauauaacaaagggca

SEQ ID NO: 140128 - RNA, 27 nt, Human
aguuuucugugagaauaaagcauuuca

SEQ ID NO: 140129 - RNA, 30 nt, Human
agcagcagcagcagguaccagcacggcccu

SEQ ID NO: 140130 - RNA, 23 nt, Human
cggggagcugggacuucuuagug

SEQ ID NO: 140131 - RNA, 26 nt, Human
gcgcacacacuccugcccacgcccac

SEQ ID NO: 140132 - RNA, 22 nt, Human
ggugccuuccacccugcccugg

SEQ ID NO: 140133 - RNA, 24 nt, Human
gggcccugugucucaggagugggg

SEQ ID NO: 140134 - RNA, 22 nt, Human
uuggcucaccaacccugcaggc

SEQ ID NO: 140135 - RNA, 22 nt, Human
cugcugcucacccacagacaca

SEQ ID NO: 140136 - RNA, 22 nt, Human
auggagcccggggcagggggag

SEQ ID NO: 140137 - RNA, 27 nt, Human
cccucuaggaaccuuggagggcauacc

SEQ ID NO: 140138 - RNA, 27 nt, Human
acucaaagcccagcuccaccacugagc

SEQ ID NO: 140139 - RNA, 24 nt, Human
agagccagacagggcagccucaga

SEQ ID NO: 140140 - RNA, 19 nt, Human
gacaugggcagaguuucuc

SEQ ID NO: 140141 - RNA, 21 nt, Human
cuguaacccuuuccugagggc

SEQ ID NO: 140142 - RNA, 22 nt, Human
aaucagcuucuauccuugacuu

SEQ ID NO: 140143 - RNA, 20 nt, Human
guccccggcuggagcccagc

SEQ ID NO: 140144 - RNA, 22 nt, Human
acugcaaacuccgccucccagg

SEQ ID NO: 140145 - RNA, 25 nt, Human
uuccuguguggcccuccugucugga

SEQ ID NO: 140146 - RNA, 22 nt, Human
uuuagcaugucaaaaugaaugu

SEQ ID NO: 140147 - RNA, 24 nt, Human
gccuugucuuggauccucagugcu

SEQ ID NO: 140148 - RNA, 21 nt, Human
cugguuucuucauuuucuucc

SEQ ID NO: 140149 - RNA, 20 nt, Human
ggauggccugggcaggggag

SEQ ID NO: 140150 - RNA, 23 nt, Human
guuugcauaaucucaguguuucc

SEQ ID NO: 140151 - RNA, 20 nt, Human
ugcugggauuguuuuuucuu

SEQ ID NO: 140152 - RNA, 23 nt, Human
ggaaaugcaguguguugcagugg

SEQ ID NO: 140153 - RNA, 27 nt, Human
gcaaaacugaggcaccugaugcauuca

SEQ ID NO: 140154 - RNA, 31 nt, Human
ggguagcgugaggacccacggggcugagcag

SEQ ID NO: 140155 - RNA, 21 nt, Human
uugcccaggagcaagugaggc

SEQ ID NO: 140156 - RNA, 21 nt, Human
augcacaccuccccugcccca

SEQ ID NO: 140157 - RNA, 22 nt, Human
gggauuacaggugugacccacu

SEQ ID NO: 140158 - RNA, 22 nt, Human
agcucuaugguucauaugcuuc

SEQ ID NO: 140159 - RNA, 23 nt, Human
uaucauucagaucuuccuuccuc

SEQ ID NO: 140160 - RNA, 24 nt, Human
gggagcccggcugcacaccaggcu

SEQ ID NO: 140161 - RNA, 24 nt, Human
cugccucucuggggagaugcugga

SEQ ID NO: 140162 - RNA, 24 nt, Human
auggggcagaggucuggaucuggg

SEQ ID NO: 140163 - RNA, 22 nt, Human
aggcugaggugggaggaucacu

SEQ ID NO: 140164 - RNA, 20 nt, Human
auucucuccaguguguguaa

SEQ ID NO: 140165 - RNA, 23 nt, Human
guucucuuuuauuuucuauucac

SEQ ID NO: 140166 - RNA, 22 nt, Human
gcauaaaagacaagcacuuugg

SEQ ID NO: 140167 - RNA, 20 nt, Human
gcaaugacacuauucauaga

SEQ ID NO: 140168 - RNA, 27 nt, Human
uugcccagcgugaggagcgaucucagc

SEQ ID NO: 140169 - RNA, 21 nt, Human
aaaauugaacaaauuaggggg

SEQ ID NO: 140170 - RNA, 22 nt, Human
accggcuuccagccuguggcgg

SEQ ID NO: 140171 - RNA, 20 nt, Human
cccugccucuaucccuggcc

SEQ ID NO: 140172 - RNA, 26 nt, Human
guuuucagaugggcaaggcacugccu

SEQ ID NO: 140173 - RNA, 22 nt, Human
ugagugugcgagugugugugca

SEQ ID NO: 140174 - RNA, 23 nt, Human
gaaucaggagaaagaugcuguuu

SEQ ID NO: 140175 - RNA, 22 nt, Human
uguuuuucauaguuugcacuga

SEQ ID NO: 140176 - RNA, 23 nt, Human
ugucugagcuuuccagugcaaug

SEQ ID NO: 140177 - RNA, 21 nt, Human
ccaaggaggggaaccuguugg

SEQ ID NO: 140178 - RNA, 23 nt, Human
ggcuccaucuacucuuugaagcu

SEQ ID NO: 140179 - RNA, 25 nt, Human
agcgggaggcucaaaccugcccucg

SEQ ID NO: 140180 - RNA, 23 nt, Human
acccauggcgccugcaguggacu

SEQ ID NO: 140181 - RNA, 29 nt, Human
acagucuucagaagaaauggcucaaaggc

SEQ ID NO: 140182 - RNA, 20 nt, Human
cuauaccacccuuguccuca

SEQ ID NO: 140183 - RNA, 23 nt, Human
ggacuggcacuuuuucuuuuuuc

SEQ ID NO: 140184 - RNA, 19 nt, Human
gcgcagcugcuggggaaga

SEQ ID NO: 140185 - RNA, 22 nt, Human
auacccucaaacugaggcuuaa

SEQ ID NO: 140186 - RNA, 22 nt, Human
cccccuccuggguucaagcgau

SEQ ID NO: 140187 - RNA, 26 nt, Human
ccacaaauccuaaaauuccuguccca

SEQ ID NO: 140188 - RNA, 21 nt, Human
uuacaaaaucuauugacuuca

SEQ ID NO: 140189 - RNA, 22 nt, Human
cauugcccuccagccuggguga

SEQ ID NO: 140190 - RNA, 24 nt, Human
uuaauccuucauuguuucauguau

SEQ ID NO: 140191 - RNA, 27 nt, Human
gggagucagaucaggggaacuauucua

SEQ ID NO: 140192 - RNA, 24 nt, Human
uuuccugaggccucccagucaugc

SEQ ID NO: 140193 - RNA, 20 nt, Human
guguuacuaaugaucacucu

SEQ ID NO: 140194 - RNA, 27 nt, Human
aaucgcuugcuuguugaaaauauuucu

SEQ ID NO: 140195 - RNA, 23 nt, Human
cagcagcugcagcagccauggcc

SEQ ID NO: 140196 - RNA, 26 nt, Human
uaaccugaagcgccuucaaacuucca

SEQ ID NO: 140197 - RNA, 27 nt, Human
uacaaguccgaagccaauguagcuugg

SEQ ID NO: 140198 - RNA, 24 nt, Human
gcccccaacuagcacagcucagcg

SEQ ID NO: 140199 - RNA, 24 nt, Human
agccaguaccuccugccccaugcu

SEQ ID NO: 140200 - RNA, 24 nt, Human
acagagagugaguguguggaagag

SEQ ID NO: 140201 - RNA, 21 nt, Human
uuuuugacagaauauguuuca

SEQ ID NO: 140202 - RNA, 25 nt, Human
ccuccuagaaugucuggagcuguuu

SEQ ID NO: 140203 - RNA, 25 nt, Human
uuuucucucacauaauaugcauuug

SEQ ID NO: 140204 - RNA, 22 nt, Human
cuccugagaguuauuucucagg

SEQ ID NO: 140205 - RNA, 22 nt, Human
gggccugggacugugucugucg

SEQ ID NO: 140206 - RNA, 23 nt, Human
uuucacucaggcuggaauguagu

SEQ ID NO: 140207 - RNA, 21 nt, Human
ucccugagaguacagauuucu

SEQ ID NO: 140208 - RNA, 23 nt, Human
uguaagguagauggcagaggcag

SEQ ID NO: 140209 - RNA, 27 nt, Human
ccgcugccaccaucuccucugugccaa

SEQ ID NO: 140210 - RNA, 23 nt, Human
uucuucauuacugcauugaaaag

SEQ ID NO: 140211 - RNA, 24 nt, Human
ucccaaacccuucgguauuguuca

SEQ ID NO: 140212 - RNA, 21 nt, Human
agcagugacccucccuucuag

SEQ ID NO: 140213 - RNA, 22 nt, Human
ucagcauugcaucguuagcuuc

SEQ ID NO: 140214 - RNA, 22 nt, Human
cuggggaagcggggguugggug

SEQ ID NO: 140215 - RNA, 23 nt, Human
cccucccuuccuuccucugccgg

SEQ ID NO: 140216 - RNA, 26 nt, Human
cacagcuggccuccagauccacauca

SEQ ID NO: 140217 - RNA, 25 nt, Human
ggcaacgggcggcagguugcagugg

SEQ ID NO: 140218 - RNA, 21 nt, Human
ucucuguggagcugccaucca

SEQ ID NO: 140219 - RNA, 23 nt, Human
aucacccaggcuggaguggagug

SEQ ID NO: 140220 - RNA, 25 nt, Human
gccggccucgaacccccacagcugg

SEQ ID NO: 140221 - RNA, 23 nt, Human
cucccccuggcugaucacucucc

SEQ ID NO: 140222 - RNA, 22 nt, Human
ugcacaucgaaggugggguggg

SEQ ID NO: 140223 - RNA, 20 nt, Human
cuuuuauuucacacaguuuu

SEQ ID NO: 140224 - RNA, 22 nt, Human
gauaccugaggcuauugcucaa

SEQ ID NO: 140225 - RNA, 21 nt, Human
agggcuagaaccuggagaaug

SEQ ID NO: 140226 - RNA, 17 nt, Human
ggcuguguuauuuacaa

SEQ ID NO: 140227 - RNA, 18 nt, Human
gccuucagaagaguggua

SEQ ID NO: 140228 - RNA, 22 nt, Human
cacgucuguaaucccagcacuu

SEQ ID NO: 140229 - RNA, 22 nt, Human
cacgccuguaauuccagcacuu

SEQ ID NO: 140230 - RNA, 24 nt, Human
ccucuacugaugagacuuccugcu

SEQ ID NO: 140231 - RNA, 27 nt, Human
gaagagucuuguuccaacagaaacucu

SEQ ID NO: 140232 - RNA, 21 nt, Human
ccaggaggcccagccugugug

SEQ ID NO: 140233 - RNA, 22 nt, Human
auucugcugaggagcccccgcu

SEQ ID NO: 140234 - RNA, 20 nt, Human
gaggaagaguaaguugagaa

SEQ ID NO: 140235 - RNA, 22 nt, Human
aacagcccuguguuaauauauu

SEQ ID NO: 140236 - RNA, 22 nt, Human
auuacagcuaacacaguaaaga

SEQ ID NO: 140237 - RNA, 22 nt, Human
gauagcucuuugcaagugccuu

SEQ ID NO: 140238 - RNA, 22 nt, Human
gugaugagggugagaaaaagaa

SEQ ID NO: 140239 - RNA, 22 nt, Human
agaggauguggaaagcacuuuu

SEQ ID NO: 140240 - RNA, 21 nt, Human
ugcugcugagugaaugaguaa

SEQ ID NO: 140241 - RNA, 23 nt, Human
uccaguauuuuuuccacuacaca

SEQ ID NO: 140242 - RNA, 17 nt, Human
agaggaggcagcuaggc

SEQ ID NO: 140243 - RNA, 19 nt, Human
gcucuuuuucucccuggcc

SEQ ID NO: 140244 - RNA, 23 nt, Human
uuacaugguuaccacaagccaca

SEQ ID NO: 140245 - RNA, 23 nt, Human
acaaaccuuuuuccuuugacaua

SEQ ID NO: 140246 - RNA, 27 nt, Human
ucuguucuguuucugugggaggagaag

SEQ ID NO: 140247 - RNA, 21 nt, Human
gacacuccuauauuuucuuug

SEQ ID NO: 140248 - RNA, 27 nt, Human
ccccucggagacgcucgcccgacagca

SEQ ID NO: 140249 - RNA, 26 nt, Human
gcugagggagacgcaggagguggagc

SEQ ID NO: 140250 - RNA, 25 nt, Human
ugcgagcuccguccugccugcagca

SEQ ID NO: 140251 - RNA, 22 nt, Human
gcuuucuuucccccauucuccc

SEQ ID NO: 140252 - RNA, 24 nt, Human
cggcagcgguuggagguuguagga

SEQ ID NO: 140253 - RNA, 24 nt, Human
ggcuuagaggcaugggcuugcugu

SEQ ID NO: 140254 - RNA, 23 nt, Human
ugccuguaaucccagcuacgcag

SEQ ID NO: 140255 - RNA, 21 nt, Human
cugcugaucgguguugcagug

SEQ ID NO: 140256 - RNA, 23 nt, Human
gccuacauuucucaauccagagg

SEQ ID NO: 140257 - RNA, 19 nt, Human
acugagcaagagucauucc

SEQ ID NO: 140258 - RNA, 25 nt, Human
ccuuguuccuaccagugucugcuau

SEQ ID NO: 140259 - RNA, 18 nt, Human
ugcuguuggucauguggg

SEQ ID NO: 140260 - RNA, 23 nt, Human
aaacucauuuuugccauacauca

SEQ ID NO: 140261 - RNA, 26 nt, Human
guuuucaaacuauauaacugaccuua

SEQ ID NO: 140262 - RNA, 27 nt, Human
uuaugaucuuaacuucacuuccauuag

SEQ ID NO: 140263 - RNA, 21 nt, Human
ggaggcggagcuugcagugag

SEQ ID NO: 140264 - RNA, 22 nt, Human
uuugcaguaggggagagagcag

SEQ ID NO: 140265 - RNA, 27 nt, Human
gaaaugaggaaaucgcuguguuguuaa

SEQ ID NO: 140266 - RNA, 21 nt, Human
acaggcggagguugcgguggg

SEQ ID NO: 140267 - RNA, 27 nt, Human
cuucccaagcccuccaauccccauccc

SEQ ID NO: 140268 - RNA, 24 nt, Human
aguaucacucccacuuccuuggaa

SEQ ID NO: 140269 - RNA, 24 nt, Human
cccaccccguccauggugcuaagc

SEQ ID NO: 140270 - RNA, 20 nt, Human
ccaaugccaaggcaaaaaga

SEQ ID NO: 140271 - RNA, 16 nt, Human
aggguccagagcagga

SEQ ID NO: 140272 - RNA, 22 nt, Human
uuccaaaugcuuuacuuuuuca

SEQ ID NO: 140273 - RNA, 24 nt, Human
cuccaagucuugaucaucagccag

SEQ ID NO: 140274 - RNA, 24 nt, Human
ucugaaguaccuagcacagugucu

SEQ ID NO: 140275 - RNA, 23 nt, Human
ggcuuccucuuuugucuuccuau

SEQ ID NO: 140276 - RNA, 23 nt, Human
ucgugucugaagagauggcacca

SEQ ID NO: 140277 - RNA, 27 nt, Human
uguguacggagggucuagccuggguga

SEQ ID NO: 140278 - RNA, 21 nt, Human
ggcaggugcauaccuugggga

SEQ ID NO: 140279 - RNA, 20 nt, Human
ccugggaggucaaggcugca

SEQ ID NO: 140280 - RNA, 25 nt, Human
gacgcacaggccaccuuccuucugg

SEQ ID NO: 140281 - RNA, 21 nt, Human
acccugaaaacaaaaucaguu

SEQ ID NO: 140282 - RNA, 19 nt, Human
ucggaauuggccgcggaaa

SEQ ID NO: 140283 - RNA, 22 nt, Human
cacggcacuccagccugggcga

SEQ ID NO: 140284 - RNA, 24 nt, Human
aggccccagggccccgcugucacu

SEQ ID NO: 140285 - RNA, 21 nt, Human
cauuuacguuucucugaugcu

SEQ ID NO: 140286 - RNA, 22 nt, Human
ggacuuacucagagaccccaac

SEQ ID NO: 140287 - RNA, 21 nt, Human
ccuccucugagacgccauguu

SEQ ID NO: 140288 - RNA, 22 nt, Human
ucaugccacugcacuccagccu

SEQ ID NO: 140289 - RNA, 26 nt, Human
gaggaggcagggccuguucugcaguu

SEQ ID NO: 140290 - RNA, 22 nt, Human
ucacagacacuuacacauacuu

SEQ ID NO: 140291 - RNA, 22 nt, Human
ccuccugagggccuuuccuaac

SEQ ID NO: 140292 - RNA, 21 nt, Human
uaucugucuuugaaagugucu

SEQ ID NO: 140293 - RNA, 20 nt, Human
cccaucaggguucucuuauc

SEQ ID NO: 140294 - RNA, 27 nt, Human
gucacccagguccagaggcggcgguau

SEQ ID NO: 140295 - RNA, 26 nt, Human
ugcccagguggaacagcacguaaccu

SEQ ID NO: 140296 - RNA, 30 nt, Human
gggccugguugaggcuggagagaacacagu

SEQ ID NO: 140297 - RNA, 23 nt, Human
ggggccuaguguucccagcacug

SEQ ID NO: 140298 - RNA, 26 nt, Human
cauuccagcugucacucugugccuuu

SEQ ID NO: 140299 - RNA, 21 nt, Human
uauauguucuucauauuuagu

SEQ ID NO: 140300 - RNA, 23 nt, Human
cuggggcagaaguuaggcacgag

SEQ ID NO: 140301 - RNA, 18 nt, Human
cgcuggugacucaugccc

SEQ ID NO: 140302 - RNA, 28 nt, Human
gagcaccgcccagccauugucucugugu

SEQ ID NO: 140303 - RNA, 21 nt, Human
ugaucaggaagauauauuccu

SEQ ID NO: 140304 - RNA, 29 nt, Human
cacaaagggcucugaagcucaagucagag

SEQ ID NO: 140305 - RNA, 26 nt, Human
ccaggaagcaagcggagguugcagug

SEQ ID NO: 140306 - RNA, 20 nt, Human
ucucagaggaaggaacagga

SEQ ID NO: 140307 - RNA, 21 nt, Human
ccucccgcgccccaccggcuc

SEQ ID NO: 140308 - RNA, 20 nt, Human
uauuauaaguaguuguagcu

SEQ ID NO: 140309 - RNA, 20 nt, Human
ggguugagagacacagcugc

SEQ ID NO: 140310 - RNA, 23 nt, Human
ggggaagagauggcggcggagcg

SEQ ID NO: 140311 - RNA, 21 nt, Human
agcucucagucuucagcucua

SEQ ID NO: 140312 - RNA, 23 nt, Human
gcccccaggccgccaggaaugga

SEQ ID NO: 140313 - RNA, 26 nt, Human
ucgccgugucauccaggcuggagugc

SEQ ID NO: 140314 - RNA, 23 nt, Human
gcucagagcagagccucuaccuc

SEQ ID NO: 140315 - RNA, 22 nt, Human
cuuuuucauuuugcagaaggaa

SEQ ID NO: 140316 - RNA, 27 nt, Human
ggaaugagagugauguuggccaacauu

SEQ ID NO: 140317 - RNA, 21 nt, Human
acuugacacuggggacgugga

SEQ ID NO: 140318 - RNA, 24 nt, Human
auacauaccuauauacucacuuuc

SEQ ID NO: 140319 - RNA, 22 nt, Human
aggcuggagugcaauggugcaa

SEQ ID NO: 140320 - RNA, 22 nt, Human
cagcuggucuagagaaagccuu

SEQ ID NO: 140321 - RNA, 27 nt, Human
ggcuggacaccuguucugcuguugugu

SEQ ID NO: 140322 - RNA, 22 nt, Human
ucuccaccugcucccugggacc

SEQ ID NO: 140323 - RNA, 23 nt, Human
accuagaccacccuccaugucag

SEQ ID NO: 140324 - RNA, 27 nt, Human
cuaccugccuuauacuacacuuaggaa

SEQ ID NO: 140325 - RNA, 19 nt, Human
ccaucauccugccuuuguu

SEQ ID NO: 140326 - RNA, 19 nt, Human
gucauugugugaaauaaag

SEQ ID NO: 140327 - RNA, 22 nt, Human
cacgaggucaggaguucgagac

SEQ ID NO: 140328 - RNA, 21 nt, Human
acucagugaguggcugugcuc

SEQ ID NO: 140329 - RNA, 24 nt, Human
gaucaaaacaaucauauucuacag

SEQ ID NO: 140330 - RNA, 23 nt, Human
cacuuccugcaccaacaccaaua

SEQ ID NO: 140331 - RNA, 26 nt, Human
gacccaaggccuccugucucccuuca

SEQ ID NO: 140332 - RNA, 19 nt, Human
ugaaggauauuuucaacaa

SEQ ID NO: 140333 - RNA, 22 nt, Human
cguguacuggcuccucuguggu

SEQ ID NO: 140334 - RNA, 23 nt, Human
cagcuccucuuccugccucucuc

SEQ ID NO: 140335 - RNA, 25 nt, Human
ugagcuuuuuaucagaaagcuuuuu

SEQ ID NO: 140336 - RNA, 22 nt, Human
gaccagccuggccaacaugaug

SEQ ID NO: 140337 - RNA, 27 nt, Human
ccucuacugcgaggccuggggagaugu

SEQ ID NO: 140338 - RNA, 21 nt, Human
caaaaacaacaguccuacucc

SEQ ID NO: 140339 - RNA, 25 nt, Human
ccuuguuccuaaaacuuuauaucag

SEQ ID NO: 140340 - RNA, 22 nt, Human
cauggaggcaccgugggccugg

SEQ ID NO: 140341 - RNA, 21 nt, Human
gacuaccuauaaauggacuug

SEQ ID NO: 140342 - RNA, 23 nt, Human
aucucagugucagaccagccuuc

SEQ ID NO: 140343 - RNA, 22 nt, Human
agccuaccccuccugcgcugcc

SEQ ID NO: 140344 - RNA, 27 nt, Human
aaaauugaaauguaaagaugaggcaga

SEQ ID NO: 140345 - RNA, 27 nt, Human
guugcccaggcuggucuugaacucuug

SEQ ID NO: 140346 - RNA, 23 nt, Human
cugugccuuccagcaucuuguac

SEQ ID NO: 140347 - RNA, 23 nt, Human
acaaucaguuaauuuaccaugua

SEQ ID NO: 140348 - RNA, 26 nt, Human
cuccaggugcucagacugccuguggc

SEQ ID NO: 140349 - RNA, 24 nt, Human
ugucacucaggcuggagcacagug

SEQ ID NO: 140350 - RNA, 21 nt, Human
caguuuguuaaaaagcuuuag

SEQ ID NO: 140351 - RNA, 23 nt, Human
acucaacugugaaaagacacauc

SEQ ID NO: 140352 - RNA, 26 nt, Human
ggccccagcuguacggagucuuccca

SEQ ID NO: 140353 - RNA, 21 nt, Human
gccagcccguccuccucuacc

SEQ ID NO: 140354 - RNA, 25 nt, Human
aguaaaacaggaaucaaucuugccu

SEQ ID NO: 140355 - RNA, 27 nt, Human
gcugccaucuuagcuguggacaaaggg

SEQ ID NO: 140356 - RNA, 20 nt, Human
gugaucauucucuaugccac

SEQ ID NO: 140357 - RNA, 21 nt, Human
aacuuguggccucaagcaauc

SEQ ID NO: 140358 - RNA, 24 nt, Human
gccauucaaccucugauuugcaca

SEQ ID NO: 140359 - RNA, 22 nt, Human
gcuuacugcaaccuuugccucc

SEQ ID NO: 140360 - RNA, 27 nt, Human
cagcccuucccaguauacuugaaaagc

SEQ ID NO: 140361 - RNA, 22 nt, Human
ugccugauucuuuaauauugcc

SEQ ID NO: 140362 - RNA, 23 nt, Human
aggggugcggcacggaggagcgc

SEQ ID NO: 140363 - RNA, 20 nt, Human
ucagaauuauuuucaucuua

SEQ ID NO: 140364 - RNA, 20 nt, Human
caggcacuccuggagauaug

SEQ ID NO: 140365 - RNA, 22 nt, Human
ucccaugccuccucuggagccu

SEQ ID NO: 140366 - RNA, 21 nt, Human
aaaugagaucaugauucugga

SEQ ID NO: 140367 - RNA, 24 nt, Human
ucugcuuugucccucagguggaaa

SEQ ID NO: 140368 - RNA, 20 nt, Human
accaugaugguuacacuuuu

SEQ ID NO: 140369 - RNA, 19 nt, Human
ugucccuggcuguugaggc

SEQ ID NO: 140370 - RNA, 27 nt, Human
acaccucaugagucuaccugagcauuc

SEQ ID NO: 140371 - RNA, 14 nt, Human
ucagcaucugugau

SEQ ID NO: 140372 - RNA, 22 nt, Human
uuggggaggggggcggugaggu

SEQ ID NO: 140373 - RNA, 22 nt, Human
uauuauuccuccuuugaagcua

SEQ ID NO: 140374 - RNA, 22 nt, Human
acacagacaaaaacacaaaaac

SEQ ID NO: 140375 - RNA, 20 nt, Human
cuacaagcuuuuaacuuuuu

SEQ ID NO: 140376 - RNA, 26 nt, Human
auccuuaggauguggcaaugaaauga

SEQ ID NO: 140377 - RNA, 22 nt, Human
uguaucuguuuucuacuuuaug

SEQ ID NO: 140378 - RNA, 25 nt, Human
gcuggguuucuaaaaugcugccuuc

SEQ ID NO: 140379 - RNA, 23 nt, Human
cccaggugccgaggccuugggga

SEQ ID NO: 140380 - RNA, 20 nt, Human
guuuucauuuacaggaaauu

SEQ ID NO: 140381 - RNA, 30 nt, Human
ccauuugaaaggagugggaggaauacagca

SEQ ID NO: 140382 - RNA, 25 nt, Human
cugucuuuucuccuccgccuguguc

SEQ ID NO: 140383 - RNA, 21 nt, Human
cuacaguguaaacauauccca

SEQ ID NO: 140384 - RNA, 23 nt, Human
cgcucagaaagcgcgggaaaggc

SEQ ID NO: 140385 - RNA, 20 nt, Human
gcccaggcgggagcgguggc

SEQ ID NO: 140386 - RNA, 23 nt, Human
aaagaaaagggagguacagaagu

SEQ ID NO: 140387 - RNA, 24 nt, Human
ucaugccagcuacuuccuccuccc

SEQ ID NO: 140388 - RNA, 19 nt, Human
gagagugagaaauggcagu

SEQ ID NO: 140389 - RNA, 23 nt, Human
uagggugauuggcugcugcagcc

SEQ ID NO: 140390 - RNA, 22 nt, Human
cacuuggaccugggaggcagag

SEQ ID NO: 140391 - RNA, 21 nt, Human
uggucggcgggggaucuggug

SEQ ID NO: 140392 - RNA, 27 nt, Human
gcgccugccaccaugccuagcaaauuu

SEQ ID NO: 140393 - RNA, 31 nt, Human
acugucucugaggacuuacuauuuuauguuc

SEQ ID NO: 140394 - RNA, 20 nt, Human
gggaaaugcuguuugcucga

SEQ ID NO: 140395 - RNA, 22 nt, Human
uacgccuguaaucccagcacuu

SEQ ID NO: 140396 - RNA, 22 nt, Human
cacgccugcaaucccagcacuu

SEQ ID NO: 140397 - RNA, 21 nt, Human
uugcccuuucauaugaucuuc

SEQ ID NO: 140398 - RNA, 22 nt, Human
gcccccagucgugucgcgucug

SEQ ID NO: 140399 - RNA, 24 nt, Human
uuucaucuuacaguuggaguucaa

SEQ ID NO: 140400 - RNA, 21 nt, Human
cugcaaccuagaccguugguu

SEQ ID NO: 140401 - RNA, 27 nt, Human
aacucccgcacccuccuuucucaccag

SEQ ID NO: 140402 - RNA, 20 nt, Human
cccugccuuucucuggagca

SEQ ID NO: 140403 - RNA, 24 nt, Human
cgcggagugugcugggcuuggggg

SEQ ID NO: 140404 - RNA, 31 nt, Human
gccacugugccuggccaacauaauguuuuca

SEQ ID NO: 140405 - RNA, 24 nt, Human
uuucagccacaugccccaggcucu

SEQ ID NO: 140406 - RNA, 22 nt, Human
cuccaacacccggcagcacuug

SEQ ID NO: 140407 - RNA, 21 nt, Human
aaccuguucaaaauguuaaua

SEQ ID NO: 140408 - RNA, 21 nt, Human
ggugaagcuaggcaucuggaa

SEQ ID NO: 140409 - RNA, 22 nt, Human
ugaucaggaaaugaguauuaaa

SEQ ID NO: 140410 - RNA, 22 nt, Human
agaccuuaaaagguauugaaaa

SEQ ID NO: 140411 - RNA, 25 nt, Human
caucuuuggagaaagugauacaaga

SEQ ID NO: 140412 - RNA, 20 nt, Human
acuauccugacuucuaauau

SEQ ID NO: 140413 - RNA, 20 nt, Human
gagaggaaggggcagaggga

SEQ ID NO: 140414 - RNA, 22 nt, Human
ucugucgcccaggcuggggugc

SEQ ID NO: 140415 - RNA, 21 nt, Human
auauguauaacuuuaacuucu

SEQ ID NO: 140416 - RNA, 18 nt, Human
cugcugccaccuccuggg

SEQ ID NO: 140417 - RNA, 26 nt, Human
uucaaacugaaggacaguugaacuca

SEQ ID NO: 140418 - RNA, 26 nt, Human
ccucugucgggggcuaagccagccug

SEQ ID NO: 140419 - RNA, 24 nt, Human
ucagcuuccuucuuuacaaaacca

SEQ ID NO: 140420 - RNA, 21 nt, Human
ccucgucgcacuccucaggcu

SEQ ID NO: 140421 - RNA, 23 nt, Human
cagcacagccuugggggaagugu

SEQ ID NO: 140422 - RNA, 21 nt, Human
cugcagcugggguucccugcu

SEQ ID NO: 140423 - RNA, 22 nt, Human
cgugagccacugcacccagccu

SEQ ID NO: 140424 - RNA, 20 nt, Human
cacuucuuaacagacaauug

SEQ ID NO: 140425 - RNA, 22 nt, Human
ugugggugcuucgaucuaccuu

SEQ ID NO: 140426 - RNA, 22 nt, Human
ccugguuggugcuggucaggcu

SEQ ID NO: 140427 - RNA, 22 nt, Human
uuuuaaaaaauuaugcuuucug

SEQ ID NO: 140428 - RNA, 22 nt, Human
guuagcccuguuccacgaaccc

SEQ ID NO: 140429 - RNA, 21 nt, Human
uguuuguaaucccagcacuuu

SEQ ID NO: 140430 - RNA, 22 nt, Human
gguuuggaagucuauugcuggg

SEQ ID NO: 140431 - RNA, 23 nt, Human
uacagucagaguaaaucacugga

SEQ ID NO: 140432 - RNA, 26 nt, Human
gccauucccuaacucccuccugcccc

SEQ ID NO: 140433 - RNA, 21 nt, Human
uccaggcuggacaguucagug

SEQ ID NO: 140434 - RNA, 22 nt, Human
ccgagauugugccauugcacug

SEQ ID NO: 140435 - RNA, 24 nt, Human
aaauaaaaugaggacauguuuuug

SEQ ID NO: 140436 - RNA, 21 nt, Human
uaggugguucucuucauccau

SEQ ID NO: 140437 - RNA, 20 nt, Human
uggcucccccaucugcucca

SEQ ID NO: 140438 - RNA, 27 nt, Human
ucuucauuccuccugguuauugguuug

SEQ ID NO: 140439 - RNA, 20 nt, Human
uccccauucuuccuaguuuu

SEQ ID NO: 140440 - RNA, 25 nt, Human
uuccagcuuaguuuuuagugucuga

SEQ ID NO: 140441 - RNA, 27 nt, Human
ugguggaggcaguagggagaugggauu

SEQ ID NO: 140442 - RNA, 21 nt, Human
cagucuccacagucuucagaa

SEQ ID NO: 140443 - RNA, 21 nt, Human
aaagaacaacagaaauuaucu

SEQ ID NO: 140444 - RNA, 21 nt, Human
ggaguccagagcaggagccag

SEQ ID NO: 140445 - RNA, 26 nt, Human
aggaauagcaagaaauuuagagacau

SEQ ID NO: 140446 - RNA, 21 nt, Human
acggccucugugcugcugggg

SEQ ID NO: 140447 - RNA, 22 nt, Human
cugagacacgagaaucacuuga

SEQ ID NO: 140448 - RNA, 22 nt, Human
ugaccaggcuggagugaagugg

SEQ ID NO: 140449 - RNA, 21 nt, Human
auuuaagccucagggcugguc

SEQ ID NO: 140450 - RNA, 27 nt, Human
ccucuugcccgcaccccucccugcuug

SEQ ID NO: 140451 - RNA, 19 nt, Human
gaaagagaaaugucugaga

SEQ ID NO: 140452 - RNA, 22 nt, Human
gcucacaccugcaaucccagca

SEQ ID NO: 140453 - RNA, 27 nt, Human
ccagcaauauguaaauagugcagaauc

SEQ ID NO: 140454 - RNA, 26 nt, Human
gauuuuugcaaccuccuccugagccg

SEQ ID NO: 140455 - RNA, 21 nt, Human
aacaagaaugaaacacuuaua

SEQ ID NO: 140456 - RNA, 27 nt, Human
ucugggaggccuuggggcccucagccc

SEQ ID NO: 140457 - RNA, 20 nt, Human
agccuggggagcugaagggg

SEQ ID NO: 140458 - RNA, 21 nt, Human
auucgaaaucagccuaggcaa

SEQ ID NO: 140459 - RNA, 27 nt, Human
agggaaagaagaguucugagcagggcc

SEQ ID NO: 140460 - RNA, 21 nt, Human
auucccuuaauuuucuaguga

SEQ ID NO: 140461 - RNA, 22 nt, Human
uugucauggcuugaagagcuua

SEQ ID NO: 140462 - RNA, 24 nt, Human
ggcaggaagucccaaacaauuucu

SEQ ID NO: 140463 - RNA, 20 nt, Human
accugccucuggguuuuugu

SEQ ID NO: 140464 - RNA, 23 nt, Human
ggucuugaacuccuagacucaag

SEQ ID NO: 140465 - RNA, 19 nt, Human
cuucuugguucuacuucuc

SEQ ID NO: 140466 - RNA, 24 nt, Human
ggcggccucuccccuguugcugcc

SEQ ID NO: 140467 - RNA, 22 nt, Human
gccugggccccggaaaaaucua

SEQ ID NO: 140468 - RNA, 24 nt, Human
uguucacugaguuaugaccagaua

SEQ ID NO: 140469 - RNA, 22 nt, Human
ggccaggaggggcccugcccau

SEQ ID NO: 140470 - RNA, 20 nt, Human
augaaguacucacacaugcc

SEQ ID NO: 140471 - RNA, 24 nt, Human
ugagcauggacucccagacugcag

SEQ ID NO: 140472 - RNA, 27 nt, Human
uucauucugcucaagucuucgccugug

SEQ ID NO: 140473 - RNA, 19 nt, Human
ugauuuuucacacaaaaaa

SEQ ID NO: 140474 - RNA, 27 nt, Human
uucagcuuucuaaaaggcauauauuuu

SEQ ID NO: 140475 - RNA, 100 nt, Human
gaggcaggagaauugcuugaacccaggaaguggaggcuucagugagcugagaacacgccacugcacuccaguccugggcaacagagcaagacucugucuc

SEQ ID NO: 140476 - RNA, 84 nt, Human
ggcuguggcuggauucaaguaauccaggauaggcuguuuccaucugugaggccuauucuugauuacuuguuucuggaggcagcu

SEQ ID NO: 140477 - RNA, 60 nt, Human
gaaaagguggugucauguuuuggggagaaucuuacuucucaaauggaaauugcacuuuuu

SEQ ID NO: 140478 - RNA, 92 nt, Human
acuggaaaucacugccauuuccaggagaucaccuauccuaguuuugaggaauagucauugagguggguuuccuuaauggcaucucuucuagu

SEQ ID NO: 140479 - RNA, 74 nt, Human
aguuuugcaccugagacagauagccucacucgccucacccuaguccugguggcauuugucucaggugcaaaauu

SEQ ID NO: 140480 - RNA, 79 nt, Human
aaaggaugaaaagguggugucauguuuuggggagaaucuuacuucucaaauggaaauugcacuuuuugcugaauccuuu

SEQ ID NO: 140481 - RNA, 109 nt, Human
ccuucaaaaaguuuguagccuaucgggguggagagauaagccaaguauccagauaaccauggcauaaggcagaauauuuucuguacuaugagagguacaaaggggaggg

SEQ ID NO: 140482 - RNA, 131 nt, Human
aucaacacaauaauugaaauauuuucaagcugauuacaccgcagcccgaggcuagccugguugcuaagggugagcuccgcgguugcuagggggaguaaaucaucuugcauuauuugauuuuuguuauagau

SEQ ID NO: 140483 - RNA, 99 nt, Human
uggggccuugguaauauaggaaaccuucuugccaauauaggaauauguugacauauuagcuauagcaaaaggcuuauauuagcaccgaaugaggcucug

SEQ ID NO: 140484 - RNA, 92 nt, Human
caguaaacauaaguuccucaggagaguuugaugugugucaggugcuuagaacagggccugauauauaaucagcccaugaugagcuauuacug

SEQ ID NO: 140485 - RNA, 78 nt, Human
gugauccacacgcuggcccaggaguucgacauuuaccgcgaggugggcggagagccugugccugugacgagggaugau

SEQ ID NO: 140486 - RNA, 110 nt, Human
ugaaccagcuucucagcucuacuguguuugacccuguguucaagguuaggggaauuauaguuucccaggucuccaucguggggguaaucagaggggcagagaaggcuuca

SEQ ID NO: 140487 - RNA, 72 nt, Human
gaaguuccaggcuguagugcacuaugaugaucguacguaugaacagccauugcacuccagccugggcaauuc

SEQ ID NO: 140488 - RNA, 99 nt, Human
gcuggauauugcuaagaauucagguagucucgggaucuccagagucuccauacuaggacaggagaucuucagaaccuggaggaauggaaauagucuagu

SEQ ID NO: 140489 - RNA, 102 nt, Human
ucaggccuggagcccaggaagucugguuucgaauuucaugcuucuaaccugagcacuguacugcuugguggaguucucugcuaguccuaccuuucaggcaga

SEQ ID NO: 140490 - RNA, 103 nt, Human
acaauagucuaagagcuaacuaguugcacuugucuuuacccuagaggcuugcuaaauaaagcauacuuucuggagggcaagugcaggggucgcuucuguuugu

SEQ ID NO: 140491 - RNA, 107 nt, Human
ugguuuagcuuaggaacagcaucuggcacauaguaaguguucagugaacguuagcuauuaccaucaucacuauuaaugugugcuagugacuguccugaguuacauua

SEQ ID NO: 140492 - RNA, 92 nt, Human
caaguugugaccuucccaguccucucuccauuugcagaucagcaagcuucugucagcaaggagggguggacaaugaaacuggguucagcuug

SEQ ID NO: 140493 - RNA, 87 nt, Human
gagguaaguuugaacccaggagggagagguuguggugagccaagauggcaccauugcacuccagccugggugacagagugagacuuc

SEQ ID NO: 140494 - RNA, 87 nt, Human
auggguagcaugaacuaagguagauaaaggcuucacgugguguuuggcauggcguagguguagauuggaccucaguuuucugcccau

SEQ ID NO: 140495 - RNA, 98 nt, Human
gaggugggaggauugcuuguuccccggagguugaagcuacagugagccuugauugugucacugcacuccagccugggcaacagguaagacucugucuc

SEQ ID NO: 140496 - RNA, 86 nt, Human
ggcuuuaggaaucgccuggcucuacccucucacuucauggcuacagauacuugugcccugagagagcaagugaauuucccaaagcc

SEQ ID NO: 140497 - RNA, 78 nt, Human
ugggccagauaguucucuguuguugggggauuucuugugcauugugggagauuucccaucuuuccucacuucuaccca

SEQ ID NO: 140498 - RNA, 103 nt, Human
ggcagaggagggcucacuuuucaaaguuccaaauagggcaaaauguguguuucccuaggaaguauuuuuuaaaaacauuuuugagauagagucuugcucuguc

SEQ ID NO: 140499 - RNA, 68 nt, Human
gguggugggugugaggaagggcugggcacuuucacugucuuuuccuucauaaacuggcaagcacuacc

SEQ ID NO: 140500 - RNA, 86 nt, Human
gagaauugcuugaacccaggagguggagguugcagugagccgagaucacgcuacugcacuccagccugggugacagagugagacuc

SEQ ID NO: 140501 - RNA, 101 nt, Human
caacccaguaaguguccccagucaaugcuucucuccauaggagaccuguaaaugggcgguggggggaggaauuuucuggucucacacacuauuauggguug

SEQ ID NO: 140502 - RNA, 84 nt, Human
agucucacucugucuccuaggcuggagugcaguggcgugaucucaucucauugcaaccuccaccuccuggauucaagugauucu

SEQ ID NO: 140503 - RNA, 105 nt, Human
uacagauauucugaaaacuuuaaguucaguaauaugccagggguucccaagaccacuugagaccugguaauuuauuggaagucucuaagggaaucagaagcugua

SEQ ID NO: 140504 - RNA, 89 nt, Human
ggcagagcgcugccucucugcaggccgugugcuuugcucgguugaucuugcagagccuaagacacaggcccagagaggcagugaucgcc

SEQ ID NO: 140505 - RNA, 102 nt, Human
ugaggcaggagaaucguuugaaccugggaggcggagguuguguugagccgagaucucgccauugcacuccagccuaggcaacaagagcgaaacuccaucuca

SEQ ID NO: 140506 - RNA, 116 nt, Human
ugagguaaguauguuauuggaaaggugugaucuauauagaacccuguacaugaaaaggaggagaugccgcuaucuuggcagggaugaucauguauuugaaauaguaacucacagca

SEQ ID NO: 140507 - RNA, 109 nt, Human
gccgcaccucccccagcccugugcucaccucccuaaacagacucuggaguucaagauccaguguccaaugcaccaugggugaauucacagcagugguggaggcagcagc

SEQ ID NO: 140508 - RNA, 82 nt, Human
aguuuuaggguacaugugcacaacaugcagguuuguuacauauguauacaugugccauguuggugugcugcacccauuaacu

SEQ ID NO: 140509 - RNA, 93 nt, Human
agagagagucucacucugucgcccaggcuggagugcaguggugugaucucggcucacugcaaccucugccuuccggauucaagugauucuccu

SEQ ID NO: 140510 - RNA, 95 nt, Human
ggacugaaagagaacugggauggaggagaauuagaggauggugugguguuucccaagacauccccugaucuugcuaucccagcaucuccuagacc

SEQ ID NO: 140511 - RNA, 97 nt, Human
aacgaacuccuggaugucuauguagaugucucauaauuuaggccaaugcuguacaacuucauguggcaucauccacauagaaugaauagggguuguu

SEQ ID NO: 140512 - RNA, 83 nt, Human
ccuccugcugaagcuucuggauuugagaggcuuuacucuccaggagagugaagcgaguugggccagagcugagagucuggugg

SEQ ID NO: 140513 - RNA, 111 nt, Human
ugucuauagaguaugugggccauuuucugcccguaaaauguucaaauguuuucucucucuaaagcuuuguucauuguaucugguggaauuuugguucucagggaguagaca

SEQ ID NO: 140514 - RNA, 115 nt, Human
cccgaccacuagcagccucuuucagucacuggaaaaugcuuacaggcaguagccaccaucauguggcacaaagugggcaucauccuagugucuaacauuuaagcugugguucugg

SEQ ID NO: 140515 - RNA, 73 nt, Human
aagggggagaauaugugaagggggcuuccaugggaggcuucgauggcccacccacccuuccauucuuccucuu

SEQ ID NO: 140516 - RNA, 100 nt, Human
gggagacccaggacccgggagagagguagaggggagcagagacagccaccagcuucuaucuucugcucuaagcacauucuuucacgaguuuaaguuuccu

SEQ ID NO: 140517 - RNA, 89 nt, Human
accuauucccuguggcuuaggugagcaugugaccaggccuggccuccugagucccacagcuuccuagccacagugauaaaagaaugggu

SEQ ID NO: 140518 - RNA, 89 nt, Human
guaggaggagucagggauuuucugguuugagagacaaugacacacaccccuaaguucaccuucucucgaauaguaggcccugcucuuac

SEQ ID NO: 140519 - RNA, 122 nt, Human
uaaaucugggcugagggaaagcauguccacaccaggugcccagacaucugguuggcuuuggcugauuuguccugcaggcaccugccuugucuggauuugcacacuuuccaaguugcccauua

SEQ ID NO: 140520 - RNA, 91 nt, Human
guugcugugcaacucagauggccauuauguagguuugcccuagugcuuagcauggcuuauuccauggccaucacuauggcacccagguggc

SEQ ID NO: 140521 - RNA, 104 nt, Human
gaguaaggggcagagcgcugccucucugcaggccgugugcuuugcucgguugaucuugcagagccuaagacacaggcccagagaggcagugaucgccaaagauc

SEQ ID NO: 140522 - RNA, 94 nt, Human
agaacaagggcuaaauucaaaucaaauuuucccuguacccuaagaaaaauaauuaggccgggagauguuugacuaagugaguaggcauuguucu

SEQ ID NO: 140523 - RNA, 96 nt, Human
cugaggcaccuccacuggccccuuugugaggcacgcuugaccuggguuucauggaaagaaugugcccucaccaaagggugcuaaacaaggccccag

SEQ ID NO: 140524 - RNA, 79 nt, Human
caaagagguguagaaucuggguugguccuucaaggcagcucauugcagcuacuggccuccagugaaacaggucucuuug

SEQ ID NO: 140525 - RNA, 130 nt, Human
aggcucacacagcaagucuuugucaaagcuuaggaauggaaguagguuguccccuccuagucaugggaucucuccaacucacuagacaaucuugcuuuacgugcugaugaacaugcucugugagcagccu

SEQ ID NO: 140526 - RNA, 73 nt, Human
cuagcugcugccagccaagcugcuaccagaccagcuccugcggaacuggcuguggcauuggugguggcauugg

SEQ ID NO: 140527 - RNA, 113 nt, Human
gcucguugcccaggcuggagugcaauggcgugaucuuggcucaccacaaccuccacuucccagguucaagcgauucucaugccuuagccucccaaguagcugggauuacaggc

SEQ ID NO: 140528 - RNA, 74 nt, Human
uggacuucauuuucuuucacgcugcugcuugcccaguggguguagacagcaagaaaaugaagaaaaucagucca

SEQ ID NO: 140529 - RNA, 131 nt, Human
gugccucaucuguaggugguugagagaaugaaaggagguagcaugagcagggcacucagcucggaggcagugccuagccaacauugcuuaucuucacugugaauuuggcuuuuuuccuacucuugaaucuu

SEQ ID NO: 140530 - RNA, 87 nt, Human
cacagccaguuucuuugaugacucaaaacguacuuugugaucuugccaagcuuugagaucaucguuacaagcagcauuuugguugug

SEQ ID NO: 140531 - RNA, 97 nt, Human
gaggcaggaaaaucgcuugaacccaaggcagagguugcagucagcagauauugcaccacugcacuccagccugggcaacaaagcaagacucugccuc

SEQ ID NO: 140532 - RNA, 110 nt, Human
gaggccccaagaaguuaaauaacuugcuuaagaucacagagcuaaugaguggcagaacaauuauucuagcucugauuuuaagggauuuacuuaacuuuuacuuggaauuc

SEQ ID NO: 140533 - RNA, 70 nt, Human
agucacuggaaaaugcuuacaggcaguagccaccaucauguggcacaaagugggcaucauccuagugucu

SEQ ID NO: 140534 - RNA, 104 nt, Human
acaccuccaaccucccugccuuugaacccuguguuaacaaugagaagcuuguuuauuugaaggcuggguucucauuggcccacagggguagguuguaauugugu

SEQ ID NO: 140535 - RNA, 90 nt, Human
ucgcagucagacguuuggcaacagcaguggaagaggcaacuggugcuuuucagcuaggccuugaaaaauugcuucagagguugauuucga

SEQ ID NO: 140536 - RNA, 121 nt, Human
ucuuuuauaguuuauguuuucauuuuggugaagccuuaaaaugagaaggcagaugacaaugcucaguaacuagucugcuuucuugacccagagccuuaaugauuuuuaagcuuauaaagga

SEQ ID NO: 140537 - RNA, 96 nt, Human
uggcaccagcuuccaaagccaggaugaagaggaggagaaaggaugggguccacaccuuguuuucuccaccaucauccaggggcucugcugcugcua

SEQ ID NO: 140538 - RNA, 121 nt, Human
ccgaugaacccagggccguucccuucauacccuuucauuaguagcucuaagauguuugauuaagguguacguuuacagaggaguugguuggugaugagcauugaacauuuggguucuucgg

SEQ ID NO: 140539 - RNA, 108 nt, Human
cccggaguuuauggucuggugagaagaucccugcucugagucacugccaagcucuagcuaugugacuuugaacagggaauuucugucccuaucuauaaaauaaacggg

SEQ ID NO: 140540 - RNA, 103 nt, Human
gaauuccuaaguauguggucuguauugugcuuguacugaccauguauauaugcuaugguuauuuagugcuagcuaagaacauaccauuuccccaguagcaguc

SEQ ID NO: 140541 - RNA, 81 nt, Human
uggguuuugaauuugcaguaacaggugugagcauucuagcagcaguuugaugaucauguaugauacugcaaacaggaccua

SEQ ID NO: 140542 - RNA, 101 nt, Human
ugacaaucuugguuaccauccauuaagugcugcugauuuuggaaagaucaugaaaaacgucuuuccaaacaugaaggcacgucguuugggcacaagaggca

SEQ ID NO: 140543 - RNA, 76 nt, Human
cgcugccucucugcaggccgugugcuuugcucgguugaucuugcagagccuaagacacaggcccagagaggcagug

SEQ ID NO: 140544 - RNA, 97 nt, Human
gucaggggugcccauaaugaauuguguuuacccugagaacaaauccacuacauuggaauuuuaggcauaaccaguaucauuaaaaggagccccuugc

SEQ ID NO: 140545 - RNA, 84 nt, Human
acuggagacacaucuaauggcugugcugaugucaagggacuuucuaaucauguucaucaguugauagcagaugcuguuuccagu

SEQ ID NO: 140546 - RNA, 90 nt, Human
gcccaggcuagaauucaguggcaggaucauagcucacugcagccucgaacuccuaggcucaagcaauccuccugcuucugccuccugggu

SEQ ID NO: 140547 - RNA, 89 nt, Human
ggagaaucauuugaacccaggagguggaaguugcagugagcucagaucgcaccauugcacuccagccuggguaacaagaaugaaacucc

SEQ ID NO: 140548 - RNA, 93 nt, Human
cugggggcugagaccacccuugccugcccccuucuuucugccuuaagaauguccuuuuaggcugggcaugguggcucacgccuguaaccccag

SEQ ID NO: 140549 - RNA, 74 nt, Human
uccugugcugcaguagaaauuagagcauguccugcuuuaugcaggcuuugcuuuaguucuucugaaguguauga

SEQ ID NO: 140550 - RNA, 81 nt, Human
ggaaagaauaaaggcuuggacucagccuagguucaaguacugcaucuugaccuggccuguaggcaagucuuuucacuucuc

SEQ ID NO: 140551 - RNA, 83 nt, Human
uggcuuuaucucuugccuugaccuccuacauuaucaacaaagugagaguuuaagaucuccugggcaggagauuucagaagcca

SEQ ID NO: 140552 - RNA, 71 nt, Human
accucucauuucuccucaaugccacugcacugaugucaacugacuuagggcaggcaugagagaacugaggu

SEQ ID NO: 140553 - RNA, 85 nt, Human
uggguagcaugaacuaagguagauaaaggcuucacgugguguuuggcauggcguagguguagauuggaccucaguuuucugccca

SEQ ID NO: 140554 - RNA, 109 nt, Human
aagugcuggauauugcuaagaauucagguagucucgggaucuccagagucuccauacuaggacaggagaucuucagaaccuggaggaauggaaauagucuagucagcuu

SEQ ID NO: 140555 - RNA, 86 nt, Human
agaccaccuuauucuuuucuuauggguauguggcaugaaugccaucauuuauuuacccagcugccaguugaagaacauuuuggucu

SEQ ID NO: 140556 - RNA, 85 nt, Human
ggagaaucgcuugaaucugggaggcggagguugcagugagcugagaucgcaccacugcacuccagccuguugacagcgagauucc

SEQ ID NO: 140557 - RNA, 131 nt, Human
gcuagucacuggggcaaagaugacuaaaacacuuuuccugcccucgaggagcucacagucuaguaugucucauccccuacuagacugaagcuccuugaggacagggauggucauacucaccucgguguugc

SEQ ID NO: 140558 - RNA, 93 nt, Human
gaggggagauuaaagaaucaauguucccaggggaaaagggccuuaaauuguuuggucuuuucaauggcugacacugucuccaacucuccccuu

SEQ ID NO: 140559 - RNA, 94 nt, Human
ccaaagucccaacggccacgccuaacaauuauaaaaguguucagcgagaguguuggcgugagugugaaugggugugcgcuggggggcacggugg

SEQ ID NO: 140560 - RNA, 80 nt, Human
agguggcagagaggcaauaucaauccuucugcaucacacagugggaaaaguuugucucauugcaguucucuuccaagccu

SEQ ID NO: 140561 - RNA, 96 nt, Human
ccgcagggagaagagcugugugcugugaugugguuuauaaauuaccauuuggaaggagcugcacagcacagcagccugcaacuacucuuccugagg

SEQ ID NO: 140562 - RNA, 81 nt, Human
gucugaaauccaggugugggcagggccgugcucccuccgaaggcucuaggggaggauccuugcucaacuuauuuuugagac

SEQ ID NO: 140563 - RNA, 109 nt, Human
uaguauguugagcaucuuuuuguaaguguacuugccaucuguagaucuucuuuggugaagugucuguucagaucugugugcauuuuuaauuggguuguuuaacuuauug

SEQ ID NO: 140564 - RNA, 97 nt, Human
aagaaagaggcaguauaguauagugguuaagagcaaggucucuggaguuuugugaccuugagcaaguuaccagaucucucugugccgcaacuuucuu

SEQ ID NO: 140565 - RNA, 116 nt, Human
cucucaucauagauuaaucacuuaguugcaagggaccaguaaauuaacagaauggugaacauuuuccuuuucuuggugcuuuugcuggaugacuagugguuucugcuggaacagag

SEQ ID NO: 140566 - RNA, 93 nt, Human
gugguguaugggaucugcauggagguggucuaugagaaagcaaaccccagugagugcugcuucgggauucucuccaacugcaaccaugccuac

SEQ ID NO: 140567 - RNA, 105 nt, Human
ugcugggcgugugaggcggcugugcugugccugugagacaggaaugguuccauuacaccaugggaaaucacugauuuauaggucccaaacugccacacaucagca

SEQ ID NO: 140568 - RNA, 98 nt, Human
gagcuggagucucgcucugucacccaggcuggagugcaguggugcgaucuuggcucacugcaaccuccaccuuuguguucaagcaauucuccuuccuc

SEQ ID NO: 140569 - RNA, 113 nt, Human
agauuuuuucugauacuacauauugucaguuuuuuaaauacucaguuugugcuaaaagaaaacauucggcaacugauaucugcuguucuguauguaucugucaguccagauuu

SEQ ID NO: 140570 - RNA, 81 nt, Human
uucaguggcauugggccuuggcugggaugcugaguuauccacuggagcaucggcaguacaggcaggcacagaggcagugga

SEQ ID NO: 140571 - RNA, 104 nt, Human
accugccuauauuacauucauuuugaugguuuguaucucaaaggaguacagugaacgaaacuuguuuaaagauacaccggaaagaaaaagagaagaggcagagu

SEQ ID NO: 140572 - RNA, 92 nt, Human
ugaagacuccaucacaguuccagauggguaggaauaccuugcagggcuggggcaagguauugccuucucuggaaggcugugcauucucuuca

SEQ ID NO: 140573 - RNA, 79 nt, Human
uguggggaucuggugcugugguucugcaugaagacaguaacggugucuucauccaggaaccacauugucuggaccuaca

SEQ ID NO: 140574 - RNA, 91 nt, Human
ggagaaucacuugaaccugggaggcagagguuguugcagugagccgagauugcaccacugcacuccagccugggugacagagugagacucc

SEQ ID NO: 140575 - RNA, 97 nt, Human
gugucccuuccaagcuguguuaacuguucaaacucaggccugugugacuccauuggggugagaggugaaagcauaacauggguacagaggggacaac

SEQ ID NO: 140576 - RNA, 74 nt, Human
cuggguucccaaauucuccuugcuguucugcaucauugucuagauggauuaguaaagaagaaugaaaacuccag

SEQ ID NO: 140577 - RNA, 107 nt, Human
ucuagggagacccaggacccgggagagagguagaggggagcagagacagccaccagcuucuaucuucugcucuaagcacauucuuucacgaguuuaaguuuccuaga

SEQ ID NO: 140578 - RNA, 95 nt, Human
ugcuaggcuuauucucuuccucauucagucucucaaucaaucaauacuuacugaguacuugucauugcaagaccugaggaauagaggggcuagca

SEQ ID NO: 140579 - RNA, 91 nt, Human
ggcgucuugcucuauuggcaggcuggagugcaguggugcgaucucagcucacugcaacccccgccucccagauucaagcaauucuccugcc

SEQ ID NO: 140580 - RNA, 75 nt, Human
uguggaaacuuuuggcuguggggaccccauuucacugaugauugaauggguccaccucugucaaaggaauucaga

SEQ ID NO: 140581 - RNA, 91 nt, Human
gcacccugugagguaggugcuuuaacugugugcacccugugagguaggugcuuuaacugugugcacauugugagguaggugcugaaacugc

SEQ ID NO: 140582 - RNA, 88 nt, Human
ggagaauggcaugaacccgggagguggagcuugcagugagcagagaucacgccacugcacuccagccugggcaacagagcgagacucc

SEQ ID NO: 140583 - RNA, 105 nt, Human
agaauaucugaacauuggacuuguucuuuagaguauauggccuuuaguucuuguggaacuaaauacagugauucuaagaucaaaagucuuaguguuugggguuuu

SEQ ID NO: 140584 - RNA, 111 nt, Human
cagaagggguuuuuaucaaaaauauguagauucuacuacaauauuuuagcuaaagaagaagaaguaguaguagcaguaguagucaguauuuuugacccugacccaacucug

SEQ ID NO: 140585 - RNA, 83 nt, Human
agagcugguguguagcggguaccuucugucugcuggcacuagguauuuuacacauuaaaucagcucguucucacaucagcucu

SEQ ID NO: 140586 - RNA, 91 nt, Human
gcuaggauugcaccacugcacuccaaccuggacaacagagcaagacccugucucuaggccaggugcaguggcucacaccuguaaucccagc

SEQ ID NO: 140587 - RNA, 109 nt, Human
gagcaaggacaaguugugaccuucccaguccucucuccauuugcagaucagcaagcuucugucagcaaggagggguggacaaugaaacuggguucagcuugauuuguuu

SEQ ID NO: 140588 - RNA, 79 nt, Human
gagaacugggauggaggagaauuagaggauggugugguguuucccaagacauccccugaucuugcuaucccagcaucuc

SEQ ID NO: 140589 - RNA, 82 nt, Human
aguuuuaggguacauguacacaacgugcagguuuguuacauauguauacaugugccauguuggugugcugcacccauuaacu

SEQ ID NO: 140590 - RNA, 96 nt, Human
gaacacaaagagguguagaaucuggguugguccuucaaggcagcucauugcagcuacuggccuccagugaaacaggucucuuugagcuauuuguuc

SEQ ID NO: 140591 - RNA, 116 nt, Human
cugaaggguggagagggccucucaugcaggcaugugugagcagcugcaggugugugagcaaaugugcaucacuggggaacaggugucuguggaugagggaggaagugagggugagg

SEQ ID NO: 140592 - RNA, 91 nt, Human
uucugaaaacuuuaaguucaguaauaugccagggguucccaagaccacuugagaccugguaauuuauuggaagucucuaagggaaucagaa

SEQ ID NO: 140593 - RNA, 75 nt, Human
guccacacugaccuucugugucauggcauaugcccaugucaggcagugcugugcuaaaggaaggauuacauggac

SEQ ID NO: 140594 - RNA, 73 nt, Human
uaagaugaguugauauucaaauauccaguuaguaaugaaaacaauacaauacugagagaaaaagcuugucuug

SEQ ID NO: 140595 - RNA, 95 nt, Human
ugugaaaccauuaugcagaugaagaagaugaagcccgagagguuaugaaacagacccaagugggcucgcucuucagucucggcauaaggaauccg

SEQ ID NO: 140596 - RNA, 110 nt, Human
gucaggacuguuggcuaagggaaugucugcuuggacugaucauugaacaaucuuuccaacuaaaagcuucuaugauucucuaaguagcaaucagcaccgacaguuaugau

SEQ ID NO: 140597 - RNA, 78 nt, Human
gggaaggcaguagguuguauaguuaucuuccgaggggcaacaucacugcccugaaaccacacaaccuacuaccucacc

SEQ ID NO: 140598 - RNA, 106 nt, Human
ugguugcaaggcaggaaauauuggugaaaugcuagcaaagucacaauuucuacucugaacaugauuugcaguguucaucaguauuuuucugaacccugcuuuacca

SEQ ID NO: 140599 - RNA, 88 nt, Human
gagcucccacggcuuuucuagaaauuggcacacaaacuccaaagcguguguggaaaugcagaugaccugggagacccaaaacaaccuc

SEQ ID NO: 140600 - RNA, 92 nt, Human
gcccggugcucgguuuguaggcagugucauuagcugauuguacuguggugguuacaaucacuaacuccacugccaucaaaacaaggcacagc

SEQ ID NO: 140601 - RNA, 66 nt, Human
cauauaugucugguauucuuggggucuaguagucuaguauaauacacauagccuaggacauguaug

SEQ ID NO: 140602 - RNA, 86 nt, Human
cccaaagcucacaguuuggcacugaaucauauacaaucucguaguuuggauggcugugugugacugcagacugcuagacagcaggg

SEQ ID NO: 140603 - RNA, 88 nt, Human
ggagaauugcuugaacccaagagguggagguugcagugagccacgauugugccauugcacuccagccugggugacagagugagacucc

SEQ ID NO: 140604 - RNA, 101 nt, Human
uuacugaguauucaccaggugcuggguggagaaagaagacuuaaagauucccuagacaucuccucuccccuagacucaggaccauggcacuuauuuucuag

SEQ ID NO: 140605 - RNA, 131 nt, Human
gaagaaguagauugggcugcaaucacacaaugggugcaucaccagugcggacaccuaggcguacagggaaccauggcuuggggaguguaaagaaggauguuaccccaggaugcaguucagacaauuuuauc

SEQ ID NO: 140606 - RNA, 89 nt, Human
uaggcuguaugcuguuaaugcuaaucgugauagggguuuuugccuccaacugacuccuacauauuagcauuaacaguguaugaugccug

SEQ ID NO: 140607 - RNA, 96 nt, Human
caggaguacgacgcugugguagcuaugaucaugccacugcacuccagccugggugacagagcaagaucuagauaauuacagucuguccugcuccug

SEQ ID NO: 140608 - RNA, 100 nt, Human
auagacaggucucacucuguugcccaggcuggagugcaguggugugacuguagcucacuauagccaccaaguccugggcucaagcgauccuccugucuau

SEQ ID NO: 140609 - RNA, 109 nt, Human
ugguggcuugguuuguguaccuauuuuucugcauuuguauuggaaaagguuucuuuuaagacauuuuccaaaaguggagaggaauauguguguucaggaagggcuuuca

SEQ ID NO: 140610 - RNA, 72 nt, Human
gguggagcagaaaggcaggaguccugcucccuggcaccaucauggagcaugcccagcccagaucugcccccc

SEQ ID NO: 140611 - RNA, 116 nt, Human
uucacuggauaugguggugggugcuuguaguugcagcuuagucagaaggcugugguagaagaaucgccugaaccugaguaguugaggcugcagugagccaugaucaugccacugaa

SEQ ID NO: 140612 - RNA, 109 nt, Human
gugugaccuuggcccugugaggcuucaccucuugagccugagaagcagaggugacaguacuggcccugguucuuagcagggggguggcgggcaggguaggggguggcgc

SEQ ID NO: 140613 - RNA, 93 nt, Human
gucuaaccagucccagugagaugaaccagguaucucagcuggaaaugcagaaaucaccugccuucucuguuggucucccugggagcugcagac

SEQ ID NO: 140614 - RNA, 77 nt, Human
ucgcuugaacccuggagguggagguugcagugagcugagaucguagccacugcacuccagucugggugacagaguga

SEQ ID NO: 140615 - RNA, 71 nt, Human
gguggagcagaaaggcaggaguccugcucccuggcaccaucauggagcaugcccagcccagaucugccccc

SEQ ID NO: 140616 - RNA, 89 nt, Human
cucuuaaaccuuuagaaaugcuacagcaucuagcuucucuagaucaauaaucacagaggcuuaagugcugaccucauaaagauaaagag

SEQ ID NO: 140617 - RNA, 92 nt, Human
ggacucauagugguagauagcuuauuggucaggguagauagagauauguuuucuguguaacugucuaguuuuuguccuaccauucggagacu

SEQ ID NO: 140618 - RNA, 74 nt, Human
cuugaucugucacccaggcugcaguguaguggcaugaucucggcucacugcaacccccgccuccuggguucaag

SEQ ID NO: 140619 - RNA, 130 nt, Human
uaaucuuaacauucucaacuaugauuaccaaagcagaaaaauaaaacacauuaaaucacaugcuggcuuaugaaagccuccaucuuuaagugacaugugcacucucguucauaguucauuggccaaagaa

SEQ ID NO: 140620 - RNA, 80 nt, Human
ugaugaaaauccacaaugucuuugagcuucugguuguguaaugcugggguuuaaagucaccauuuguggguuuggcauca

SEQ ID NO: 140621 - RNA, 101 nt, Human
uucaguauagcaaggugcuagguuuuuuccuuuccccaccugucucuuagccuggggaauuaaaugagaagccuuagaauggguggcccuugugaccugaa

SEQ ID NO: 140622 - RNA, 102 nt, Human
cccagcaugauucauaccuguaaucuuacccauucuugauuuagaugagauuuggauuucgaguugaugcuagaauggguuaauacuuuugaggauguuggg

SEQ ID NO: 140623 - RNA, 74 nt, Human
ccuuugaacccuguguuaacaaugagaagcuuguuuauuugaaggcuggguucucauuggcccacagggguagg

SEQ ID NO: 140624 - RNA, 95 nt, Human
ccaucucugcuuauuccucugccacgucuuucccuucuccucucugcucucauaaagaagaaugggagaugaaaguggaggggcagcugaggugg

SEQ ID NO: 140625 - RNA, 111 nt, Human
gauccagauagaugauauguuucuacuagugguugauggccucuuucagcuccaucgcuauggaggcgagguucaucaauaacucagagaaacuuguguccagaguugguc

SEQ ID NO: 140626 - RNA, 82 nt, Human
aguucuaggguacauaugcacaacaugcagguuuguuacauauguauacaugugccauguuggugugcugcacccauuaacu

SEQ ID NO: 140627 - RNA, 114 nt, Human
aauguuuacugaguauucaccaggugcuggguggagaaagaagacuuaaagauucccuagacaucuccucuccccuagacucaggaccauggcacuuauuuucuagucaauauu

SEQ ID NO: 140628 - RNA, 114 nt, Human
gguaguggugauucaaagcaagaugguagcauuggagaggaugagauauggucagaugaggauauauuuuaaaaguugagcuaacaggauuugcugaggaaucagaagugaacc

SEQ ID NO: 140629 - RNA, 79 nt, Human
ggccucccaaagugcugagauuacaggcaugagccacugcaccuggcccuugccucuauuucaaagcuacuuuggugcc

SEQ ID NO: 140630 - RNA, 76 nt, Human
aucugucuuuccaagccuuccccgggaucagaguuuuuaaggauaauuugguggggagaggcuugggaaguggggu

SEQ ID NO: 140631 - RNA, 77 nt, Human
ggaaaaugaguggaagaccuggcucccucucuucucucccguuaggcacaagacgguguaaauccuggucuuccucc

SEQ ID NO: 140632 - RNA, 87 nt, Human
gucccuaucacucggagcggagaccugagcuaugagucaucagugaggugcuauacucagagccauuccgcucaggucauggaggac

SEQ ID NO: 140633 - RNA, 94 nt, Human
acaggagaauugcuugaacccuggagguggagguugcagugagccgagauugcaccauugcacuccacccuaggcaacaagagcaaaacucugu

SEQ ID NO: 140634 - RNA, 130 nt, Human
ggcagggaggugacgagguaggggcagagcggauggaagccggagaucccagguucccggaauacuccggcuggggccuucgggcuucuccuguccccucccuacccccgugccucggguuucucccucc

SEQ ID NO: 140635 - RNA, 97 nt, Human
gaccaugaagccagagucuccaggacuccucacucaaccucggccauggacgcagguugggugugaggggggucccagccuuucggucuucuauuuc

SEQ ID NO: 140636 - RNA, 96 nt, Human
gcuacuucuaugugucccaugguacugccacagaagagucucagcucucuccaggauucaguucuaaggucagugccuaagauaaaaauggagugu

SEQ ID NO: 140637 - RNA, 76 nt, Human
gaagaagaagaauggguuuggugagaggguuccaauauuaacaacccaacuucaagcucauuccucuaaccucuuc

SEQ ID NO: 140638 - RNA, 84 nt, Human
cacucuguaauaaagaacuuggaaagggagguuccaagauggccaaauaugaacagcuccagucuacagcccccagcgugagug

SEQ ID NO: 140639 - RNA, 78 nt, Human
gcuuugaaagagauguggugugugaagacgaagaugccuuuuguuugucuuuggagaauauugcaacacuacaaaagu

SEQ ID NO: 140640 - RNA, 82 nt, Human
ugggcgccuguaaucucagcuacuugggaggcugagacagagaauugcuugaacccaggaggcggagguugcagugagccua

SEQ ID NO: 140641 - RNA, 75 nt, Human
cuucaccaaguugucauuugagcacaguuugaggaguguaagacagucaugcggacuugagggguacaagggaag

SEQ ID NO: 140642 - RNA, 69 nt, Human
cucccaggcaauauuccaggauaggcugccaguuggacuaaggaagccacuccugcggaacccugggag

SEQ ID NO: 140643 - RNA, 78 nt, Human
auguccaaagacucaacaguuagacuacuuuucuuccacucauuuuaaagaaaaaugucuaugaaguguuuuggauau

SEQ ID NO: 140644 - RNA, 89 nt, Human
ucuuaccccaguauccuauuaucucauaccuaaggcagugaugguuucucagaccucuuagauugagaagauguggcauggguguaagg

SEQ ID NO: 140645 - RNA, 92 nt, Human
agucucucucuggcuggaccuggacugcagucacacucuaagagcuccucuuucuacaccucugccagugggcguucggucagagacaagcu

SEQ ID NO: 140646 - RNA, 95 nt, Human
uggccucugggacucagauuccuccucuuuaaaauggugcuaauaauagcacccacccucugugaggaggaugcugugaggacaaaaugagauca

SEQ ID NO: 140647 - RNA, 127 nt, Human
ggaagcaucccugcugcggacgcuuucacuucuaaagagucuugucugcuaauaagagugcccauggcccaggguggcagcagggggauuuagaaagggcaugaugauggcacuagcggcugcuuuc

SEQ ID NO: 140648 - RNA, 83 nt, Human
aggcugagguaggaugauugcuagcuagaguccaggaguucaggauuaaaaugagcuaugaucauaccacugcacuccagccu

SEQ ID NO: 140649 - RNA, 105 nt, Human
aaugaaguggaaucaagguggcaagaaaauuuagaaucguuucugauagggacuuucccuuauccuaaauguguuuugaaggcacacguuauuuccauugucauu

SEQ ID NO: 140650 - RNA, 98 nt, Human
gugacuuuccaggugucacacagugaguggcauaaucagaguacaauuugagucaugcccauacaucacauugccagugauuacccaaggaaagugac

SEQ ID NO: 140651 - RNA, 101 nt, Human
auaagcugcucuaauugccaagaauucacaugugguuguaugcagcuuuacugggagacugaaguguaucugcaugugauucugcugugauggacacuugu

SEQ ID NO: 140652 - RNA, 93 nt, Human
acacugccucuagauuguuauuuuguccaagagagagaucauggagagagucucucucgcucacggaggcucugucuuucuaggaguaugugu

SEQ ID NO: 140653 - RNA, 113 nt, Human
agacagugcugggucaaacagccuuuauuuuagcaguugugagacccuagagaacuccuuugguguuuuggggucuccccagcaugcacaauggggguuaugcuagcaucucu

SEQ ID NO: 140654 - RNA, 92 nt, Human
uuugagauuuuauugaguacuacuaaucuugacauauuuugguuggcaccacauucuugguauaguggguuagugguugaauaguuugcaga

SEQ ID NO: 140655 - RNA, 84 nt, Human
ccccaccccaguggagcucaccuuccaguaggucuaaacugguuugauugaguuccauggaaaacaacaaagugggguaagggg

SEQ ID NO: 140656 - RNA, 77 nt, Human
aaacggaugggccugggggccacuuugcacaggguucuccagagcccugcccauccugccuccaccacuuccuguuu

SEQ ID NO: 140657 - RNA, 84 nt, Human
ucauuccucuuaaucuucacuaaaauggacaaguauucauugagcaccuaaugcguguucaguauggugggagaugagggauga

SEQ ID NO: 140658 - RNA, 104 nt, Human
gugcugggucaaacagccuuuauuuuagcaguugugagacccuagagaacuccuuugguguuuuggggucuccccagcaugcacaauggggguuaugcuagcau

SEQ ID NO: 140659 - RNA, 107 nt, Human
aguuuggguaaugaagccacagagauuugcugauacauuugcuaggcacgacuucuggucauuuagaaagcuauuuuguggcuucaucaauaagguauuccccagcu

SEQ ID NO: 140660 - RNA, 89 nt, Human
aagcccuugacuggggcugcugccuuucucucagagaugcccugcccagugaggaggaaucuagagaggcagucuggccacaguugcuu

SEQ ID NO: 140661 - RNA, 71 nt, Human
guggcaguuccagccuuauccucagggucugacacaaucgggcuuuuacgaaaggcauguuuuacugccac

SEQ ID NO: 140662 - RNA, 76 nt, Human
ucgcuugaacccgggaggcagagguaguagugagcugaagucccgccacugcacuccagccugggcaacagagcga

SEQ ID NO: 140663 - RNA, 76 nt, Human
uugcuugaacccaagaggcggagguugcagugagcuaagaucaugccacugcacuccagccugggugacagagcaa

SEQ ID NO: 140664 - RNA, 90 nt, Human
uggaacuggaggagcuguccugugucagccugaaauaaucaaaaggaucaaaaauccuguuuuaggcaacauaggaagacuccaacucua

SEQ ID NO: 140665 - RNA, 91 nt, Human
augaugccaggacugcagcuucagggacuuguggcagaugcacagggugccucuggcucccuggagcuccacacugcagucccagcucugu

SEQ ID NO: 140666 - RNA, 103 nt, Human
ugcuguaggcuguaugcuguuaaugcuaaucgugauagggguuuuugccuccaacugacuccuacauauuagcauuaacaguguaugaugccuguuacuagca

SEQ ID NO: 140667 - RNA, 101 nt, Human
gagccuuuuaaugacacaguggggccaguuggagcacugauccuggucauuacuccugcacccuggccugcagccuuccucucagugucuuauuugggcuu

SEQ ID NO: 140668 - RNA, 79 nt, Human
caguauaacuaugacccuucuggaacugcuucuccacaaaccacuacagagcaggcaauuuuggaaggucaguaugcug

SEQ ID NO: 140669 - RNA, 102 nt, Human
ccgguagguuuagaaugaggucugugucacugugguauuacgauauuuugacugguuauuauaaccacagugucacagaguccaucaaaaacccaugccugg

SEQ ID NO: 140670 - RNA, 131 nt, Human
cuuuugagcugcuucuuauaaugugucucuuguguuaaggugcaucuagugcaguuagugaagcagcuuagaaucuacugcccuaaaugccccuucuggcacaggcugccuaauauacagcauuuuaaaag

SEQ ID NO: 140671 - RNA, 78 nt, Human
ugugggaagaugcuggcaaggugcuggagggcccuggaggcaaagggccugccucgaccuugccccccauaacccaca

SEQ ID NO: 140672 - RNA, 78 nt, Human
aucgucugagcccaggaguuugaggcugcagugagcuacaaucacaccccugcacucaagccuggguuacagagugau

SEQ ID NO: 140673 - RNA, 102 nt, Human
gugcacuacagacuccagccucccuuugaagccagguuccagagcuuccucccuuuggccuggaaccucaacagcaggauugggaugaggauggaaguguac

SEQ ID NO: 140674 - RNA, 97 nt, Human
ugcuuccuuaccuacaagaaaauuuagaaguuggugcaaauggcauuuccaugaguacuucucaugcaucuuugcauauuucaccuggggggaagca

SEQ ID NO: 140675 - RNA, 74 nt, Human
ugguuucauuaaaauguguaagguuggcugggugcaguaacucaugccuguaaucccagcauuuuaggagacca

SEQ ID NO: 140676 - RNA, 105 nt, Human
ugggugaggaacagguagagaaguguaagugagacaaacuucccugccauuugccaaaguggcagcacauaauguaucaugagugccucuacccucugauaucca

SEQ ID NO: 140677 - RNA, 88 nt, Human
gccugcgggguauuguagaaacgcugcgcugccuaucacagcuugugaugugacacguucauucugcaaguuuaaacuucgccuaggu

SEQ ID NO: 140678 - RNA, 130 nt, Human
ggucugugugaagcaucacuuugcagggauuacuaaugguggggcagcaggucugugaauuaaguuaucucuugaccucacccucaugucaacacaaauguaauuccuaaacaagaugcauugccagucu

SEQ ID NO: 140679 - RNA, 130 nt, Human
cuucucacuuucccuucacacacagucguguaguuuugcgcuugcuugauuaaucucuuggccucagucgguuuucuaccauauggaguugguucauucucucgaauggcuguguaguccaguguguggg

SEQ ID NO: 140680 - RNA, 83 nt, Human
cacauuccuguuagcugaggucaccugacucugcuugucguuuuugcacaggcagacgugugcauucuggagagcagggagug

SEQ ID NO: 140681 - RNA, 101 nt, Human
ggacuacaggcacaugcaaccacaucuggcuaauuuucuugaguuuuaguagagacugggucucauuauguuguccaggcuggucccaagcuccugaguuc

SEQ ID NO: 140682 - RNA, 82 nt, Human
cugggaggcagagguugcagugaucaggaauugugccacugcacuccaaccugagugacagagcaacacucugucuuaaaag

SEQ ID NO: 140683 - RNA, 84 nt, Human
agucucacucuguugcccaggcuggagugcaguggugcgaucucagcucacugcaaccuccaccuccuggguucaagugauucu

SEQ ID NO: 140684 - RNA, 125 nt, Human
auuguauugcagcagguuggcagccucaguaaaucuccauuuguaaaugugacagucagcagaaucuccaguuacagucaacucaaagcaagcaggggcaugccacauacauguucauauauagu

SEQ ID NO: 140685 - RNA, 107 nt, Human
gcuauugugacaaucuugguuaccauccauuaagugcugcugauuuuggaaagaucaugaaaaacgucuuuccaaacaugaaggcacgucguuugggcacaagaggc

SEQ ID NO: 140686 - RNA, 79 nt, Human
gauggucucauaacugaauauauuaaaaacuuaaauuguauacuuuaaguuggugauuguaugauauaugaguuuuauc

SEQ ID NO: 140687 - RNA, 105 nt, Human
cacgcgagucagaaccuaaagugcucucugggcaaccugaguggguagagugauuccgucuuucucuggcccugcuaggcccaaaggagaggugugacuaucgug

SEQ ID NO: 140688 - RNA, 85 nt, Human
cucuugaccagagggucucaaaugagggacauuuuaccugccaggggacauuuccaauguuuggggacacuuuugguuaucagag

SEQ ID NO: 140689 - RNA, 112 nt, Human
cucagccucucccugauguaaucuggguuccuuguguggcaacaguaaugggaagaaaggaccugaaauauuaguugauuccaagggacccucuaagguuagagaggcagag

SEQ ID NO: 140690 - RNA, 95 nt, Human
ccguggcccguguucucuccuuuuguccccauagugugacuccgccaggaacuuggaauggcugaagacugugaaugagagucaugggucugugg

SEQ ID NO: 140691 - RNA, 98 nt, Human
ggugcaaacaccccguucauguaacacgggccugaggucagcaguagaggaccaguauugguuuuggccccagccucugcguggauggauugaacgcc

SEQ ID NO: 140692 - RNA, 103 nt, Human
ggcaggagaauugcuugaacacaggaggcagagauugcagugagucaagaucaugccacugcacuccagcacuccagccuaagugacagagcaagauccuguu

SEQ ID NO: 140693 - RNA, 72 nt, Human
cugccucucugcaggccgugugcuuugcucgguugaucuugcagagccuaagacacaggcccagagaggcag

SEQ ID NO: 140694 - RNA, 77 nt, Human
ggcugagaccacccuugccugcccccuucuuucugccuuaagaauguccuuuuaggcugggcaugguggcucacgcc

SEQ ID NO: 140695 - RNA, 93 nt, Human
ccaguauauuucugcagucugguauguuuuucccccuaagaaccucagcugagaaauaaagcagguuaacaaagcuguaugaaaugucacugg

SEQ ID NO: 140696 - RNA, 85 nt, Human
ggauuaguucuggagagagcagguugcuaagaagaaucuggcuucuucagucagcgcucuugcuuccuaucucuccaugugaucu

SEQ ID NO: 140697 - RNA, 107 nt, Human
ccaucuggcagaacacugggcaaaagagguucugauucuggccuguuacuugcuguacaaacuugcacaaggccagagaggacucucuuuucccaucugcaaagugg

SEQ ID NO: 140698 - RNA, 116 nt, Human
ccagguaucagucuuuuugucuauuccuggauuuuggugaaaacagaaucuaaucuuauauucgcagccuuaagguuagaaggucacuuacauccaguaaucacaguaagaucugg

SEQ ID NO: 140699 - RNA, 89 nt, Human
cccuguccugucuucgaguauuuguuuuuaaugcugggugucgaucgagacaacaagcgcucagagcaaagcaaggaugcauuacgggg

SEQ ID NO: 140700 - RNA, 119 nt, Human
agguucuggugaauucaggaugguauuuuugucuuugaauaguuucugguugcauuucuauagugggggugaagcuaggggaacuucugugaucuuccugaggucacuucaaagugccu

SEQ ID NO: 140701 - RNA, 130 nt, Human
cuuucugugccacucaggaagcaaugggcaugauucagcagaggagaggagaguuuagaacugguuaugcuuccuucuccaacccucccugcaaaaacacuggccagcuccugacaucacaguaagacag

SEQ ID NO: 140702 - RNA, 108 nt, Human
gaaucugguugguuccuuaaagaucacuugacauggacaggguuuggaaaacuauuugaucauuacggagacugucaccgucaagagguguuuauuaucauuagguuu

SEQ ID NO: 140703 - RNA, 106 nt, Human
ggcacuuggaaccgucuuggggaauauagcuugguaauugaacugcuuaagcuuauuauuaauauuuaagcuauaguuccaggcccauuccagaggucccccagcc

SEQ ID NO: 140704 - RNA, 112 nt, Human
ggagacaugauguagcagaugaugggacugucuuacauaacuggaucuuuuagaacuaucgaagauuaaguaguaaaaugguauaaaaaguuucuugacaauguuauuuucc

SEQ ID NO: 140705 - RNA, 89 nt, Human
cagguguggacuaccaugccuggcuaauuuuuguauuuuugguagaaacaggguuuuaccauguuggccaggcuggucuugaacuucug

SEQ ID NO: 140706 - RNA, 90 nt, Human
ccucagccucccaaagugcugggauuacaggugugaaccaccaugcccggcagugauucauuucuaaacccagcuuguuaaaaggugagg

SEQ ID NO: 140707 - RNA, 113 nt, Human
ugacacuuucuguaaacgccaucugugcuuuucucccauuuguacugcccuguauauccccguucagcauugccaguguuuccagccaccucuuaaagcauucugaaguuuca

SEQ ID NO: 140708 - RNA, 90 nt, Human
gacagcagaacuuuucuauccaaaugaaugccgucccauggaaaguggcuguccugggaggcuacacguuucuccaauggugaugcuguu

SEQ ID NO: 140709 - RNA, 109 nt, Human
cucuguuuccuaauucuaggcuagcuuuuuuugugagaugugaaucuuacucuugugaaauaugggaucaagacacauaagcaaaagucuagugagaauuaggacagag

SEQ ID NO: 140710 - RNA, 79 nt, Human
ccuaccaugacuguucucaaaguuugaaguugagcauaccgaugcgccacuccugcuucaaugcuugagaagucguagg

SEQ ID NO: 140711 - RNA, 101 nt, Human
ugugaaacacagccaguuucuuugaugacucaaaacguacuuugugaucuugccaagcuuugagaucaucguuacaagcagcauuuugguugugaaaaaca

SEQ ID NO: 140712 - RNA, 114 nt, Human
agcuauugugacaaucuugguuaccauccauuaagugcugcugauuuuggaaagaucaugaaaaacgucuuuccaaacaugaaggcacgucguuugggcacaagaggcaaaucu

SEQ ID NO: 140713 - RNA, 112 nt, Human
acucuuugagaugacugguauugaauggagcagucuuugaaaggcaccaacccuuccuaacugaugguggucucuugaaagaggcucuuccaaauuugucuucugaaagugu

SEQ ID NO: 140714 - RNA, 123 nt, Human
agugugaagacaaaagccacuuucuaaggaugguggagcagaaaggcaggaguccugcucccuggcaccaucauggagcaugcccagcccagaucugccccccucugaauuuccuguugcauu

SEQ ID NO: 140715 - RNA, 96 nt, Human
ggcguaucagguuucagaggaugcggcugggaacgggaguagaggugaggggucguugcaucugucgcgguguguaucuuuuggggguucagcgcc

SEQ ID NO: 140716 - RNA, 76 nt, Human
uuguugaagggcagugaagguagguuucagguuugguuuuacaaaccuguuaacuaccuccuguccagcuugacag

SEQ ID NO: 140717 - RNA, 109 nt, Human
ucagucuuuuugucuauuccuggauuuuggugaaaacagaaucuaaucuuauauucgcagccuuaagguuagaaggucacuuacauccaguaaucacaguaagaucugg

SEQ ID NO: 140718 - RNA, 110 nt, Human
ucugcucaugauuacugggccaauaccacugcaaugacugucagaacaauucuugugaaaguuguuuuuauaagccuuguaguuuguugaaguugagguucaagggcaga

SEQ ID NO: 140719 - RNA, 99 nt, Human
acuuuuggcucauuuuuugaugcaugugaccugggauuauaaaugugaaauuagguuuacgaaaggauccagugucauugugcaucaugggcaaggagu

SEQ ID NO: 140720 - RNA, 87 nt, Human
aucuuguacauuuuccccacacuuggaaucagccauuccuccagggagugcagguucacaggcugggcucuaagagaauuauaaggu

SEQ ID NO: 140721 - RNA, 98 nt, Human
gaucauuugagaccagaaguuccaggcuguagugcacuaugaugaucguacguaugaacagccauugcacuccagccugggcaauucagcaagacauc

SEQ ID NO: 140722 - RNA, 95 nt, Human
guuccuuaggccacacccugcccucccuggacugccugaccucgcuccaaggcucaggggaagguucugagggcaggugugaaaaugcuuggaau

SEQ ID NO: 140723 - RNA, 108 nt, Human
uccucccccaggcauucuggucacuguuccuuuuuguugagaucauucucggugucucauauagcuggguugcagcuccguucuuugccaggaggugguaauagagga

SEQ ID NO: 140724 - RNA, 89 nt, Human
ggagaaugggccugaacccgggaggcggacguugcagugagccgagauugcaccacugcacuccagccugggcaacagagcgagacucc

SEQ ID NO: 140725 - RNA, 81 nt, Human
gcagcgacgcugaguuucaagaaagccaagauggcugaguccacaggcucacccacgggugcguuuagacugggaugcugc

SEQ ID NO: 140726 - RNA, 102 nt, Human
gggcagcaaaaacauccauuccgcugcgcaacaguugucauuuuucuaacaucugaaaacuccagaaggagauggugauaaaugugguaccggauucugccu

SEQ ID NO: 140727 - RNA, 101 nt, Human
ccgaggcuacgugaaggaacacuuugccuggagacauuucuacugguaccuuaccaaugaggguauccaguaucuccgugauuaccuucaucugcccccgg

SEQ ID NO: 140728 - RNA, 86 nt, Human
ccuguacaaagcagccuuggaccaggagggaaaaccccaaggcucugcagccucccugcuccccuccguuuaaggcuguggucagg

SEQ ID NO: 140729 - RNA, 87 nt, Human
gauauguuucuacuagugguugauggccucuuucagcuccaucgcuauggaggcgagguucaucaauaacucagagaaacuuguguc

SEQ ID NO: 140730 - RNA, 96 nt, Human
ugcccaugauguuuucaguacaaaucuaagucccaagauuagguuggaaaggguauuucuuguuggcuuaguuuggguuggaauuuagcaugggua

SEQ ID NO: 140731 - RNA, 97 nt, Human
ccaggccugaccugucucuugaaggaguauuuguguugaagaugggugguaacguucagcaaaagccaugcccaggagacaggcacaguacccaugg

SEQ ID NO: 140732 - RNA, 93 nt, Human
uuggguccuaguaguaccaaagugcucauagugcagguaguuuuggcaugacucuacuguaguaugggcacuuccaguacucuuggauaacaa

SEQ ID NO: 140733 - RNA, 77 nt, Human
gggacugcugucugcugucuacacuacacacuacuacacugcugucugcugugugugauaaggacacagauaguccu

SEQ ID NO: 140734 - RNA, 96 nt, Human
gagguccagcuugcagccgucgugguuuugugcaaagcagcugagugucccucuguuaaugugugcaaaccauggugagagcugagccuggaucuc

SEQ ID NO: 140735 - RNA, 112 nt, Human
ccuacauguguuacacucaguguguaaauaacugugaagaggcaauugucagauagcaaauugggcaccugcuguguacgguauauugcacuggggcugacggguguguagg

SEQ ID NO: 140736 - RNA, 100 nt, Human
guuuugacaaaugcagauacauguguaacugaacuuaugacuuuccuuauagaaacuucagaaaguucccucauaccccuuaucucaaucuugucacuac

SEQ ID NO: 140737 - RNA, 114 nt, Human
ucagaucaguagugacaugagauuuucauaggagcagaaacccuauugugaacuccaaacacaagggaucuagguuaugcacuacuuaugagaaucuaaugccugaugaucuga

SEQ ID NO: 140738 - RNA, 101 nt, Human
auggcaugcacguguuggaaguuaguggaggcuaucuccccaguggucaaaggaggucuugcuggagaaauuauauuuuacuaacuugaagcagcagcugu

SEQ ID NO: 140739 - RNA, 87 nt, Human
gggggacagagcgagacuccaucuuuucugggagacuccauugggagacugucuuuuuugggagacggagucgugccuuaguuuccc

SEQ ID NO: 140740 - RNA, 69 nt, Human
aucaaucacacugggugaccuuuacucccugucaggucaguaagagucacccaguguaaacagcaugau

SEQ ID NO: 140741 - RNA, 86 nt, Human
gggcgggggcccucgucuuacccagcaguguuugggugcgguugggagucucuaauacugccggguaaugauggaggccccugucc

SEQ ID NO: 140742 - RNA, 92 nt, Human
acuccagccuggccucugaccccaguucaauccgaccaugcccaagcccaagcgggccuuuccuccagaacugcuccggggccuggcugugu

SEQ ID NO: 140743 - RNA, 106 nt, Human
caccugccuauauuacauucauuuugaugguuuguaucucaaaggaguacagugaacgaaacuuguuuaaagauacaccggaaagaaaaagagaagaggcagagug

SEQ ID NO: 140744 - RNA, 91 nt, Human
gggauggaaaaugcagacacaauauagcaaauagagggucuuuuccugucauggaaaucggucagcccugaugcuucugcauuucuuuccc

SEQ ID NO: 140745 - RNA, 103 nt, Human
guccaucuucaguggcauugggccuuggcugggaugcugaguuauccacuggagcaucggcaguacaggcaggcacagaggcaguggauccaucggagguggc

SEQ ID NO: 140746 - RNA, 75 nt, Human
ccaguucuccuuuaguguucaggcucaaaugaaaggccacuuucagcaaguuuuccugacauugucggagacugg

SEQ ID NO: 140747 - RNA, 71 nt, Human
uggaaacuuuuggcuguggggaccccauuucacugaugauugaauggguccaccucugucaaaggaauuca

SEQ ID NO: 140748 - RNA, 80 nt, Human
aauacacacauaucagaguacugugauagacucagauaaaaugauacaaauuauaguguucuaacuaugucaaauguguu

SEQ ID NO: 140749 - RNA, 99 nt, Human
gaaauggagucuugcuuugucaccgaggcuggagugcaguggcaugaucucugcucacugcaagcuccaccucccggguucacgccauucuccugccuc

SEQ ID NO: 140750 - RNA, 100 nt, Human
cuuuuucucugcccuucgucauuaugcagccugugaacagcgucugggaaagugguggucauugguugcauaauuugaucugaggcuuauggaggaaagg

SEQ ID NO: 140751 - RNA, 110 nt, Human
uagaaauuuaccagagauagcaccuucugacccagugcagauuggacgguuaauugguagguuggaguugagucucacguugaaacagaaugaagugcuuccuggagcua

SEQ ID NO: 140752 - RNA, 82 nt, Human
aguucuaggguacaugugcacaacaugcagguuuguuacauagguauacaugugcuauguuggugugcugcacccauuaacu

SEQ ID NO: 140753 - RNA, 86 nt, Human
agagucuugaucugucacccaggcugcaguguaguggcaugaucucggcucacugcaacccccgccuccuggguucaagccauucu

SEQ ID NO: 140754 - RNA, 91 nt, Human
cggacccugcugugagcagcucccuauuccaugacaguguguugagcucuccauugucagaggcugguaggguguucagcuagaggugccg

SEQ ID NO: 140755 - RNA, 88 nt, Human
gucuauuaugagucugacuggcacagacaucugucaaggaagaaggauucuuugagcguauuugugucagucaacugcauauauggac

SEQ ID NO: 140756 - RNA, 82 nt, Human
gguuuccuggaacuuugggggaucauuauaaaaauacuaggguaaaaaagcaaccuuaguaaucccagcaauuugggaggcc

SEQ ID NO: 140757 - RNA, 101 nt, Human
ccaucugccaauuccucaggaggacagaacaaaccagugaggcaugaagauuagauuauguaacgcucgaggauugcuguuuucaaagaggaaacaaaugg

SEQ ID NO: 140758 - RNA, 110 nt, Human
gcucacaaaaccuagguggggaugaaagcugagaaagcgaagaggugguucaggggaucacucuuuccuacuuguuccucucaccucaaacucaccuucuacugcacagc

SEQ ID NO: 140759 - RNA, 72 nt, Human
cugaaugaccugcagucagggcccagaguugggacucuauacuacccugggcucuggucuguagguuuguag

SEQ ID NO: 140760 - RNA, 91 nt, Human
ugcccacauuccuguuagcugaggucaccugacucugcuugucguuuuugcacaggcagacgugugcauucuggagagcagggagugagug

SEQ ID NO: 140761 - RNA, 115 nt, Human
agaggguugacauuagguuuggugagaugaguugcuuggcacagaucagcagaacaggacccuggugauaaggcaucuggcuuugcuaaccacuuaucaucuuccauuauucucu

SEQ ID NO: 140762 - RNA, 96 nt, Human
guuugugggaggaggacuggcaaaaauaugagaguaggaguuugggcucuugagcuugggccuggccuucaaauuuccacucuuucacucacuagc

SEQ ID NO: 140763 - RNA, 74 nt, Human
gcaagguuugggaaauaagcugauaguaaagucauguaacacuuucugugcagguuaacauuucuggaccuugc

SEQ ID NO: 140764 - RNA, 75 nt, Human
cacugugugauuugauuccaagcuacccaugaagaaacccagacucagaggucacuugccuagggucacacagug

SEQ ID NO: 140765 - RNA, 89 nt, Human
gcagggagacuggagagaaagcgaagauguagcccaaagccauagugcuuugugugcccugcaacugagcuuucccugcagcuuucugu

SEQ ID NO: 140766 - RNA, 99 nt, Human
ucagggaagugaaggaaguccagucuggugagaguguuaagucugagagaaagacuagauagaacgaggcucggaggucuccuaauuuucauccccuga

SEQ ID NO: 140767 - RNA, 102 nt, Human
aaaaccaaaaaccuuucucccacucuaauagaugagucacauaaugggaaaacaaacaaauguaucaucuauuaaagugggagaacuugguuuuguaguuuu

SEQ ID NO: 140768 - RNA, 102 nt, Human
ugugguccacaaggggagagcaggggacacagcauuggcaggaaccucaaauuccugaccaaacccucuuccacacaaugccucccgaaagaaaggaaccca

SEQ ID NO: 140769 - RNA, 74 nt, Human
gcugcugcugaagucaccugaaaacucaacuaagcuaaagagccuagauggguuacucagaugacuggcagugc

SEQ ID NO: 140770 - RNA, 76 nt, Human
gucucuguugcccaggcuggagugcaguggcgcaaucucagcucacugcaaccuccaccuccuggguucaagcgau

SEQ ID NO: 140771 - RNA, 81 nt, Human
gggcuugcuggguuuacagauggcaaagaucuggcaaauuaaaaauagccuuaggccaaagaucaaacccaaggugggcuu

SEQ ID NO: 140772 - RNA, 84 nt, Human
agucuugcucuguugccuaggcuggagugcagugaugcaauuuuggcucacugcaaccuccaccuccuggguucaagcauuucu

SEQ ID NO: 140773 - RNA, 87 nt, Human
ucagagacaccucucauuucuccucaaugccacugcacugaugucaacugacuuagggcaggcaugagagaacugagguuuacaugg

SEQ ID NO: 140774 - RNA, 94 nt, Human
aguucaaggcugccuccucucugucuucauuaugugaauugaauguggucacacaucuguguuggagcagaggcaggggcugcagcuuucagcu

SEQ ID NO: 140775 - RNA, 94 nt, Human
aagguauuuucugagcugugagccugccuuccagugacauguucuaaaaauugcaaguuauuugaggaggcuuuacagccaauaggaaguucuu

SEQ ID NO: 140776 - RNA, 106 nt, Human
ugggucccagauucuuccugguggaggcauucggagagcaacacccuggccuuaacacacuacauaucuuugaauuucacacgggggcagccuucugggaaaacca

SEQ ID NO: 140777 - RNA, 75 nt, Human
ccccagcccggaagccuccacuaucuccagcccagacaaacccugugguccagaggaggaaugagggugcagggg

SEQ ID NO: 140778 - RNA, 85 nt, Human
cugacaugugcauuauccaugucauuuuaaacaaagugaccuauggaaggguacgcugugcugugacaugguaaugggcuguugg

SEQ ID NO: 140779 - RNA, 98 nt, Human
aggcaccuggggguguagaccgggguggagccgcaugggcaccuggggguguagaccgggguggaacuauguaaacaucccacacacucaggugacuu

SEQ ID NO: 140780 - RNA, 124 nt, Human
gauaacauggaguuaugauagcaguggaggcaggcaggggaaaagggcccaugagauauggauggcagcacucucccccauucccugccauccccacugcacauguauaagcuaaguaaauauu

SEQ ID NO: 140781 - RNA, 69 nt, Human
cuuccaugggcaggggccaugacagggagauaggccacaccuuucccagguggaaccugcagauggagg

SEQ ID NO: 140782 - RNA, 130 nt, Human
agacguggggucucgcuauguuggccagguuggucuugaacucuuggccucaagcauuccuccugccucagcuucccaaagugcuaggauuacagccaugagccaauaguaguaaaaugacuuuuuguuu

SEQ ID NO: 140783 - RNA, 81 nt, Human
cgaauggaccacuggagggguucaaagauuccaguucuaauaugggaaugagccucuuugaucucuuccggggcuuuuucg

SEQ ID NO: 140784 - RNA, 121 nt, Human
uguauugcagcagguuggcagccucaguaaaucuccauuuguaaaugugacagucagcagaaucuccaguuacagucaacucaaagcaagcaggggcaugccacauacauguucauauaua

SEQ ID NO: 140785 - RNA, 117 nt, Human
cugcagcccaagcaaaauggaaauacaagcaaucauguaguucacuguguccaucagacaggaacaaaucagaugaccaggaauugagagacugaacauuuccucagguggcuggag

SEQ ID NO: 140786 - RNA, 79 nt, Human
augacagcaagacacuggcccuggaauccuccgugucacaugugggcugcugacaggaagaaugugcuuuuguuguugu

SEQ ID NO: 140787 - RNA, 86 nt, Human
agacaugucaaggcaggagccaucugaucgaccuuagacuuggcaagcugguggcuaaguccagugcucacugccgacaucugucu

SEQ ID NO: 140788 - RNA, 80 nt, Human
cuggcugcuccucuccauguacccauuccccuuggggugcaagccacaccacccuucacuugggggaugauagcagccag

SEQ ID NO: 140789 - RNA, 85 nt, Human
gcugucagaucagguuccugauuggaguucucuuaucugcucugguuuggagggcugccccauucgggaaucuguuuuguuuugc

SEQ ID NO: 140790 - RNA, 99 nt, Human
cuccuguaguccuagagcguuucucuugaacccuaauuuuuaggucucaaagagugggcuucagagauaaagagguuuaggcagggacagggcgaggag

SEQ ID NO: 140791 - RNA, 63 nt, Human
aaaggcagacggugaaugccuugagaaauuguucagauucaaggacaagcauuuguugccuuu

SEQ ID NO: 140792 - RNA, 84 nt, Human
gugaggcucuggcaaggugugggcuagagaugcgacucaguuggaucuaucucucagaaggcuaccuuguaaguagaguuccac

SEQ ID NO: 140793 - RNA, 108 nt, Human
cagauugcacgaacauuucauuuuucacacagggucaccagaauaccaucaauuuuuugguaucacugucaaaagugauccuagcaccuucugaaauaacgugagcug

SEQ ID NO: 140794 - RNA, 104 nt, Human
aauguucuggcacauaguaauuaauuaagaaaaucgagcacccuuaauuaccuagaaugcaggguuguuaguuuuuugguugacuuuuguuuugcuggggcauu

SEQ ID NO: 140795 - RNA, 101 nt, Human
gaggcaggagaaauugcuugaacccaggagguagagguugcagugagucaagaucaugccauugcacuccaaccugggcgacaagagcaaaacucugucuc

SEQ ID NO: 140796 - RNA, 111 nt, Human
ucccucugcuagugaguacaaaugaagucugugggccaacaaggagcgaggagcaguuuccuggaagcccugggcugguguuugacuugcuuugagauagaauaaauggga

SEQ ID NO: 140797 - RNA, 79 nt, Human
caucagcuauuccuguucuagaaagggcacucuggcugcaauguggaggagggagugacuggaggaagggagguaagug

SEQ ID NO: 140798 - RNA, 103 nt, Human
uggugggacacagagccagugacugacauagaagagcagugggguagaauuacaguuccaucuggugccuuuucucugagcaaagcuguauccaucaccacca

SEQ ID NO: 140799 - RNA, 106 nt, Human
aguaucuggaauucuauugugugugagucugugcaggaacacaaugagucucaaagugaaaaaaacuuuggauuccugguuccuacagcacuuuuguucagauacu

SEQ ID NO: 140800 - RNA, 90 nt, Human
gcugcaguggaaaggaguuugugacauugacauugacagcaugaaaaugggucuugccagugcaugugagacugccucccaacacucagc

SEQ ID NO: 140801 - RNA, 91 nt, Human
uuguggauauugaaguuugaagccuguuguucaucuauagaugcacuggaugggauuggaagucuucagauuucaguaggguuuuccacaa

SEQ ID NO: 140802 - RNA, 77 nt, Human
guggcucgacucuugaccauggcugggguuccugaggaugagcuaaacccuuuccauguacuggggguugaggccac

SEQ ID NO: 140803 - RNA, 98 nt, Human
caacaggugcaaguguuaaaggguaugauccuucaguggaacaaagccuccgugucaccugagggauagcaacaugccuacaagcacugcaagaguug

SEQ ID NO: 140804 - RNA, 75 nt, Human
ucccacagucgggaggaaaagaaagaagacucuguuguucauuguuuuuaucuuuuucuccagaugccuguggga

SEQ ID NO: 140805 - RNA, 96 nt, Human
cacuuucaugucugccuucuuugcuggaaggugccucccuauuccacagacuuuggaucagugggugugggggaauccaaggcagaccaugaaaug

SEQ ID NO: 140806 - RNA, 130 nt, Human
gaagaggccuuuacuccuguuuucuuccauucucaccccucuguuucugccagaauugugacagcagggcagaaaaugggcuuuucgugcagaguugacaagauacaggguagugaagacaagaaucuuc

SEQ ID NO: 140807 - RNA, 106 nt, Human
ggagacgaacacauacacagaagauucagacacacuugcaauguauugcuggggauucuccagcauuggcaugauggagaggguggagaaucauuugaccgccucc

SEQ ID NO: 140808 - RNA, 93 nt, Human
ucccuccugugucccaaaacgaaaacacuccuauauuuuguagcgccuuccagaauggggcagcggaaacuaguguugggacaaaggaggcga

SEQ ID NO: 140809 - RNA, 76 nt, Human
uaugaacuggccacuuuucagaugaaaccuggugggccagcucuguggggugaugcauuuaaaagggcaguucaug

SEQ ID NO: 140810 - RNA, 115 nt, Human
uuagcaccugccuauauuacauucauuuugaugguuuguaucucaaaggaguacagugaacgaaacuuguuuaaagauacaccggaaagaaaaagagaagaggcagaguggcuug

SEQ ID NO: 140811 - RNA, 120 nt, Human
ccacaccagaggcugugaccauggcuaguagacaguggcaacauagucauccccaagaugcuaaucuucugcuggaacugucauacguuaucauggucaauguaaaccugguuugugugg

SEQ ID NO: 140812 - RNA, 86 nt, Human
aguucugcagggcugcugccucaacauuuuagguucugauagcuguauucucaguccuggagugacagguguagccugcaguuacu

SEQ ID NO: 140813 - RNA, 90 nt, Human
ugcauuacccuccccaacuuaaaaucuuuugauaacccaggcagcuggguuauccccaauuuaaagucuuuuuguuguagcuguauggca

SEQ ID NO: 140814 - RNA, 88 nt, Human
ggagaaucacuugaacccaggagguggagguugcagugagccaagaucgugccacugcacuccagccugggugauagagcaagacucc

SEQ ID NO: 140815 - RNA, 99 nt, Human
uagugacaagggcaucccaaggcacuugcccagagcugcagaguugugugugccauaccugcggcucaaagggaaggccuucuauccccugaguuucua

SEQ ID NO: 140816 - RNA, 92 nt, Human
cccugccgcaggagagccacuuucagagaugcccugagugaucgucaccagcugcauccugcaaacuucaucuugcugucccuguggcuugg

SEQ ID NO: 140817 - RNA, 112 nt, Human
uuuucaauuuuuaaaaauuagauuuauugcagacuggccucaagcucccagacuauauuuuuuagcugcauuauuuagggguugaaaugccagcuuuugagacuuuugaaaa

SEQ ID NO: 140818 - RNA, 77 nt, Human
cuggagaguuccauucacuuccugaaacgugcaccuguuucaggugcauguuuauucagugugcauggauauuuaag

SEQ ID NO: 140819 - RNA, 100 nt, Human
guuucccacuuuucucccaucugucauuuuucucuuuccauaaaaagcuaauggugacguuaucaaagagugaaggagucagaggcuaaggguggggaac

SEQ ID NO: 140820 - RNA, 100 nt, Human
gaggcaggagaaucguuugaaccugggaggcggagguuguguugagccgagaucucgccauugcacuccagccuaggcaacaagagcgaaacuccaucuc

SEQ ID NO: 140821 - RNA, 78 nt, Human
cugcaguggugauguguugucacuucaggacaccccacuaccugaauugcagcaguguugcgaaucaucacucugcag

SEQ ID NO: 140822 - RNA, 68 nt, Human
aaacguguggugauugaugcuuucauggacucuguugccccaaguccccaagccuuguaccagcguuu

SEQ ID NO: 140823 - RNA, 87 nt, Human
aggcuguaugcuguuaaugcuaaucgugauagggguuuuugccuccaacugacuccuacauauuagcauuaacaguguaugaugccu

SEQ ID NO: 140824 - RNA, 105 nt, Human
cugggauuacaggcaccugcugccaagucuggcuaauuuuuguauuuuuaauagagacgggguuucgcuauguuggccaggcuggucucgaacuccugaucucag

SEQ ID NO: 140825 - RNA, 128 nt, Human
uaaaacucaccaucaaauagauguaaucuuauuaauuacacauuuuguauuuuaauuauuucaaggagugaagaaaacaggguguuuuuguuuuuguaguucugauuacucauuuaugcauuguuuug

SEQ ID NO: 140826 - RNA, 81 nt, Human
ggccacuuccaccuuccagggcauaggugaccccuguggaaaacaaguaccccuggaacauccuagaaguggagguggacc

SEQ ID NO: 140827 - RNA, 96 nt, Human
uggaggaaugggagcuaugggcaaauacugggagcuggcuggaugccaggauacagcagccaucugccaucauuacccuagcuucaggauccucua

SEQ ID NO: 140828 - RNA, 78 nt, Human
ucgcucuuuguugcccaggcuagagugcaguggcaugaucucggcucacugcaaccucugccuccuggguucaagcga

SEQ ID NO: 140829 - RNA, 114 nt, Human
uauuauugggcaccuguuaugugagacacuguccuaggcacugugggauaacaacagcaaacacuucacacaacagccuggccuuccuguguuuuacaacagcuccuaaagaua

SEQ ID NO: 140830 - RNA, 87 nt, Human
uguugauggucucauaacugaauauauuaaaaacuuaaauuguauacuuuaaguuggugauuguaugauauaugaguuuuaucaaua

SEQ ID NO: 140831 - RNA, 116 nt, Human
cucguggcugcugcugcuccugcucucccucucccuccuccaggccacggauuucaugucccugugacugguggggcccauggaggagacaggaagccucaaguuccagugcagag

SEQ ID NO: 140832 - RNA, 86 nt, Human
gguggcacuggcaggaugugccuccugaggugugucgaguguucucuacauggggcacuguggaggugucaucggcucaguucccc

SEQ ID NO: 140833 - RNA, 93 nt, Human
aaaucucucaaccacugcaagcuuuuaaaagucuggcgcaucuugacuuucuuuucaccuauaacagccagcuuggauucauuugagagauuu

SEQ ID NO: 140834 - RNA, 108 nt, Human
uguggagaauuaaaaaggguagugaggcuggcauuuauagaaucuggcuuucuuguauuggguggaaagcuagaugaaaccaguuucucucagccuuuucucuccuca

SEQ ID NO: 140835 - RNA, 123 nt, Human
uagugagaugaacccgguaccucagauggaaauggagaaaucgccugucuucugcgucucucacgcugggagcuguagaccggagcuguuccuauuuggccaucuuggcuccucucuccucug

SEQ ID NO: 140836 - RNA, 75 nt, Human
gcuuccccaugccucaguuugcucuggguuagcucagcagcagcacucaauauuccacagaagcaagggggaagc

SEQ ID NO: 140837 - RNA, 102 nt, Human
gcuggaugaugaauccuuguuuuucagguggcuccaaaaagaauguugcauguguucagaccauccugagcagagccaccaaauuuagugacagugucuagc

SEQ ID NO: 140838 - RNA, 88 nt, Human
uccagacacuuucuuccuucaguucagggaacccucaauacacaguaagaaugaagagguugcaggucugagcuugaggaggacugga

SEQ ID NO: 140839 - RNA, 94 nt, Human
ccacagugggggugcccgggcugggucccacuggggaagcucaaggcagcccuggccuuucccucauucuccacccagucaggccccugcgugg

SEQ ID NO: 140840 - RNA, 130 nt, Human
caucaaagaauaaauaagcugcucuaauugccaagaauucacaugugguuguaugcagcauuacugggaaauugaaguguaucugcaugugauucugcugugauggacacuuguaaguuuguuccuggag

SEQ ID NO: 140841 - RNA, 88 nt, Human
ugaguauacuuggauuuuugguaucuguggguuggggggacgguccaggaaccaauaccccauggauaccaagggacaacuguacuua

SEQ ID NO: 140842 - RNA, 77 nt, Human
ggaaacuggggccuucuuugaguacuagugaguaagacauuuugcaacagugcugaguaugaaaggcccuggucucu

SEQ ID NO: 140843 - RNA, 77 nt, Human
cugcagggcugcugccucaacauuuuagguucugauagcuguauucucaguccuggagugacagguguagccugcag

SEQ ID NO: 140844 - RNA, 76 nt, Human
gucuucauaucuccagguucugcuggagcaauuaccucccccaucuggcuccuuaggaccuagagguaguaaaggc

SEQ ID NO: 140845 - RNA, 99 nt, Human
agccuuuacuuaaaaucuucagugucuugucaaaucuagcucuguaucagaugcuggaauauuccuaacauuugacaaacuggaguugaacuaaaggcu

SEQ ID NO: 140846 - RNA, 110 nt, Human
guccacuggcccuucuugucuuagguccucacacacagcucugcucaguucaaucacccagaaugcaggcugguuggugaggcaaauuuggacagaagaagucagugucc

SEQ ID NO: 140847 - RNA, 77 nt, Human
gcuugcuggguuuacagauggcaaagaucuggcaaauuaaaaauagccuuaggccaaagaucaaacccaaggugggc

SEQ ID NO: 140848 - RNA, 88 nt, Human
ggagaauugcuugaauccaggaggcagagguugcagugagcugagaucaugccacugcacuccagccugggugacagagugacacucc

SEQ ID NO: 140849 - RNA, 93 nt, Human
aggugcacccuguggaauuuggcagaaaaggcccaaucgcccuuuagagggugaacugaagccuguuccugcaauguucuaaggagugccccu

SEQ ID NO: 140850 - RNA, 69 nt, Human
gguauacuuacuagcauauuauauagcucuaagaguguagaguuauaugaugugcuagugaaguguauu

SEQ ID NO: 140851 - RNA, 129 nt, Human
gggacaucaaagaauaaauaagcugcucuaauugccaagaauucacaugugguuguaugcagcauuacugggaaauugaaguguaucugcaugugauucugcugugauggacacuuguaaguuuguucc

SEQ ID NO: 140852 - RNA, 109 nt, Human
ugguaccuuauuauugaaaaucagauaaacuuugguuggguggguauuuggaggaaucuuuuaagucuuuucuuaagcaaaguuuggacauucuaaaauaagguugcca

SEQ ID NO: 140853 - RNA, 100 nt, Human
cugcccccgcccucuggacccgagugacucaggccuuuguuuguccuuccugguagaggcggguucccucccucggcaagaugccggagugcugggaugg

SEQ ID NO: 140854 - RNA, 105 nt, Human
gggaggagagaaggaaccauagauucugagaaacacaccaggaugacuaggccuggaggaguccagggugggccucagacccucacuucuugucuggcaccuccc

SEQ ID NO: 140855 - RNA, 82 nt, Human
agucucacucugucacccaggcuggagugcaguggcaugaucuugguucacugcaaccucugcuucugggauucaagagauu

SEQ ID NO: 140856 - RNA, 130 nt, Human
ggaagccuucccuuaccucagccugguugagggcccccugggcuguuuucacugguugaugguaucugaucccuuccagccugagguuccuggagggccaguccaggucugaggucugguucaugcuucc

SEQ ID NO: 140857 - RNA, 90 nt, Human
acacuggacagauggauguugaugagcuugugugcagcaguucuacuggaaguauguacaaggggcucagccagccaauuuggacggugu

SEQ ID NO: 140858 - RNA, 107 nt, Human
auaugcugaguugggacaggagcuaaggauagaggugaggaaacccgcagacaacagcgacaugcuccucaucuuugagucccagcgaaccuuuccacugugugugu

SEQ ID NO: 140859 - RNA, 101 nt, Human
ugaguguaugugugagagagaauguuauguuuaucacugaguucccauuguuucauucucauagcacuuauuucuucauacuuucuauacacauuuacucg

SEQ ID NO: 140860 - RNA, 76 nt, Human
ucacucuguugcccaggcuggagugcaguggugcaaucuuggcucacugcaaccuccaccucccggguucaaguga

SEQ ID NO: 140861 - RNA, 87 nt, Human
cccagacagugcccguuuugagaugugaccugguggccaccaaaugccuuggccucagugcaaacuaagcagggcacacugccuggg

SEQ ID NO: 140862 - RNA, 89 nt, Human
gggacuuaacugagaggaucugaguagcagacacccuaagagcaugucauugucuucucaccaguuacucuccaguuggcuagaguccc

SEQ ID NO: 140863 - RNA, 94 nt, Human
ucccuuuuauuaaccaucuucccuuucucgaguauacacaaguagaaaagaaacagugaaguaccccgauagggaggguggggagaggauggga

SEQ ID NO: 140864 - RNA, 102 nt, Human
cucuccuauaaccaggauucacggguccaggaaucaagggauagaaguaggagugguuccucucaccuguccccucaacuggaguucuacugguuuggaggg

SEQ ID NO: 140865 - RNA, 88 nt, Human
ugcccuguugaccagaauuuguuagauugcuauuacaaugcugauuauauuuuauagcaauuacugacauaagguuauacuuugggca

SEQ ID NO: 140866 - RNA, 76 nt, Human
ucacuuuggugauaucaugggaagguguacuuccggugaugccuagaggucacguccugugaugucauuaggcuga

SEQ ID NO: 140867 - RNA, 96 nt, Human
ugauucaaagcaagaugguagcauuggagaggaugagauauggucagaugaggauauauuuuaaaaguugagcuaacaggauuugcugaggaauca

SEQ ID NO: 140868 - RNA, 104 nt, Human
aggcacacacgcaugguuuucucuuuuauaugcuagauuucaucccugacagcagaaaaugauuggcaaugguuaugacggagaacaugcaauagcgugguccu

SEQ ID NO: 140869 - RNA, 99 nt, Human
aaccuccagcacaccaccaaugaauagcaguaauaccagcauaauugucugcaguucugcugagauacgugcucuauuuuauuggcuuggcuguagguu

SEQ ID NO: 140870 - RNA, 90 nt, Human
ugugucagucaggauaggucaacugcuguaacaaacagcccucaaaucucaguggcugaacaccauacagcucugcuucuggcucacaca

SEQ ID NO: 140871 - RNA, 75 nt, Human
auccugggaaggacccuacccagucauuuuaucuaccccaaccaugguuaaaguggcuggaguggagucuuggau

SEQ ID NO: 140872 - RNA, 82 nt, Human
agucuugcucugucacccaggcuggagugcaguggugccaucuuggcucacugcaaccuccgccuccccaguucaagugauu

SEQ ID NO: 140873 - RNA, 131 nt, Human
cauuaaaacucaccaucaaauagauguaaucuuauuaauuacacauuuuguauuuuaauuauuucaaggagugaagaaaacaggguguuuuuguuuuuguaguucugauuacucauuuaugcauuguuuug

SEQ ID NO: 140874 - RNA, 76 nt, Human
cagugggaaggggggccgauacacuguacgagagugaguagcaggucucacagugaaccggucucuuucccuacug

SEQ ID NO: 140875 - RNA, 97 nt, Human
cucuugcccaggcuggaguucagugguaugaucacaacucuccuaagccucaaacaccugggaucaagugauccucuggcuucagccucccaaguag

SEQ ID NO: 140876 - RNA, 88 nt, Human
gugggaggaggacuggcaaaaauaugagaguaggaguuugggcucuugagcuugggccuggccuucaaauuuccacucuuucacucac

SEQ ID NO: 140877 - RNA, 77 nt, Human
gaaggguaccugcuggagaccugugugguuugugggguggguuucuuauaucacugaaucuaaagugggugccuuuc

SEQ ID NO: 140878 - RNA, 93 nt, Human
ggagaagaggucuugcauaccagcacaguggauggggaauggugugaccucugucccugcucucuucucugcuggcuuaagggucuauucucc

SEQ ID NO: 140879 - RNA, 119 nt, Human
cuugagaaaagacaacuaguauuugaggaaggugugagaaaugagccuaaagagguagaugagacucaaaggaggcugauaaagauaccacagcuacaaguuuuuguuauauucugaag

SEQ ID NO: 140880 - RNA, 59 nt, Human
aguucacaguggcugaagcuguucccauaagacccugaaucuagcagccacuguguacu

SEQ ID NO: 140881 - RNA, 86 nt, Human
aggagggaaaggcccaggagggggagaaaggcagacucagccagggaugggugaggguuucccugucccaaagcaagacccaagcu

SEQ ID NO: 140882 - RNA, 87 nt, Human
gguugccgugauugaggaggugcuaccagcgucugcugggcagagaccagggaugcugcuccacaucccacaaugcacaggacaauc

SEQ ID NO: 140883 - RNA, 96 nt, Human
gagggcuuuagaaaugcugugccagagcugcaccccagaccaacaaaaucagacucuccaggaugcggccaaggcaucaguauguggaaagcuuuc

SEQ ID NO: 140884 - RNA, 113 nt, Human
ucuauaugagacuaacuaagguauuugccccuuggagcuuuuauagucuuuaaaaugagauaaugucugugaaaugcuuuuaggacacugccuggcauaaacacucaugaaga

SEQ ID NO: 140885 - RNA, 114 nt, Human
aguguuggguugacuugaauggaggugauuguuuuagaagaaggucagaagacuagauuugcuuuucucuccaauuugaaauaccucuucuauucgaggacacccaggaacauu

SEQ ID NO: 140886 - RNA, 103 nt, Human
cucucaccccucuagccuuaaauccagaaucuagacugaauauggacugaaugggucagauuuggggaaauguguuucuggggacagcugagggaccagagag

SEQ ID NO: 140887 - RNA, 106 nt, Human
ggcuaagaguaacaggugcuggagccagacuuccuggguucauauccugguucuaccaauuuaccagcugugugaacuuaggaaaauuccucuccgccucuuaguu

SEQ ID NO: 140888 - RNA, 88 nt, Human
agcauaugacagcaagacacuggcccuggaauccuccgugucacaugugggcugcugacaggaagaaugugcuuuuguuguuguuguu

SEQ ID NO: 140889 - RNA, 89 nt, Human
aguauuauuaagacuuuuccugggucugggcugugccuguugcugccucugagacaagucagccuaauacaggaaaagcuuaauucucu

SEQ ID NO: 140890 - RNA, 88 nt, Human
ggagaauuucuugaacccaggagguggagguugcagugagccgagauugcgccacugcacuccagccugggcaacagaacaagacucc

SEQ ID NO: 140891 - RNA, 72 nt, Human
aaauacaaauuccugggucuccuggcagacuugcuaaaucagaaucuccaggggauccuggaauugguguuu

SEQ ID NO: 140892 - RNA, 90 nt, Human
gggaggaucgcuugagccuaggaggucaaggcugcagugagcugagaucacaccacugcacuccugccuaggugacaaagugagacuguc

SEQ ID NO: 140893 - RNA, 124 nt, Human
agugguaaugccguguguugauagaaauauguaaucgaucuuuucuuuggugggcaauuagcaauauugaggaaaguuaaagauguauguaucccuaccacuugaaacaccuggaaaugccauu

SEQ ID NO: 140894 - RNA, 77 nt, Human
gggaaaggcccaggagggggagaaaggcagacucagccagggaugggugaggguuucccugucccaaagcaagaccc

SEQ ID NO: 140895 - RNA, 83 nt, Human
augaguauugaucugucccagccugugcauugcuccgaggcaguucugaguggaugauguacagaugggauuccucagcucau

SEQ ID NO: 140896 - RNA, 84 nt, Human
gacaugucaaggcaggagccaucugaucgaccuuagacuuggcaagcugguggcuaaguccagugcucacugccgacaucuguc

SEQ ID NO: 140897 - RNA, 81 nt, Human
ccaggguuagaugacugcgggaagccuuugaucccaacccccaaggcuuuguauauuugaucauuugugaucuaacccugg

SEQ ID NO: 140898 - RNA, 81 nt, Human
cucucaugcaggcaugugugagcagcugcaggugugugagcaaaugugcaucacuggggaacaggugucuguggaugaggg

SEQ ID NO: 140899 - RNA, 130 nt, Human
uaguguucacauguugcucaguuuugcuaacugauaaaucauuuaauccucuucuucauauguaugaguacuaucuuauaucuguggucaagagugagguaagcaagcuccaacagacccugagaaccua

SEQ ID NO: 140900 - RNA, 85 nt, Human
aguuccuaugugccccacaggaaagcgcccuuaaccacugaugaguguugauguuuuucugcacuagaaggcacuauguugaacu

SEQ ID NO: 140901 - RNA, 128 nt, Human
ggacaucaaagaauaaauaagcugcucuaauugccaagaauucacaugugguuguaugcagcuuuacugggagacugaaguguaucugcaugugauucugcugugauggacacuuguaaguuugugcc

SEQ ID NO: 140902 - RNA, 89 nt, Human
ccagggaaaguaguaaguuguauaguuaucuucuaauuggggccuaauaucccuaccccacaacaauacaacuuacuaccucacccugg

SEQ ID NO: 140903 - RNA, 119 nt, Human
uguuccucuaagguugucauaauaagugcaucauuaccaaguauuacagcagguacugguuugcaucagggcugcugacguugucugugggcauuguuaagaaaccaaucugggaaaca

SEQ ID NO: 140904 - RNA, 103 nt, Human
ugugagcuccugaggagucaggccugagucugugggucaucuagcacauccuuaauagaaugauugccuggaugugaccacccucacccccaacccucacaca

SEQ ID NO: 140905 - RNA, 94 nt, Human
uucugucuuuugaauucugucgugacuggggcuaaacaacugucacuggcaagugacaagaggcacagacagcaggggaaauaaaaagagagaa

SEQ ID NO: 140906 - RNA, 79 nt, Human
agacacugaauuggacauugauuuccuuuucucugcgucgaaaugucaaggaaaguugcaagucugugauuuuguguuu

SEQ ID NO: 140907 - RNA, 76 nt, Human
uagaaauauguaaucgaucuuuucuuuggugggcaauuagcaauauugaggaaaguuaaagauguauguaucccua

SEQ ID NO: 140908 - RNA, 88 nt, Human
ggcugggacugaggucauguucugucagguuccaaagagcgccaggaagacucugagaccacagagcacggccugcuuucucccagcc

SEQ ID NO: 140909 - RNA, 85 nt, Human
aguuucacucuugucacccaggcuggagugcaguggugccaucuuggcucacugcaaccuccgccugccgaguucaagcgauucu

SEQ ID NO: 140910 - RNA, 84 nt, Human
gagggcugucaccauuagcacucucggagcugggagaagucccugagcccugaaggguguuuugggcaguaugugacagugcuc

SEQ ID NO: 140911 - RNA, 131 nt, Human
caucacccagugguucucucagcaacagacauguccaguggaccguaguguugugacggucgcccaucugcgcccaguaccucggaucaugcggaacauguugucaaagcugcagauugccugugacaacg

SEQ ID NO: 140912 - RNA, 131 nt, Human
guuuaaaugguuauccgggagaauuccuguuguguggaagaugcuuugcccuuucuucaucuggaaaucauuuuuccauccuuuaggucacagcuuaaacaugauuuucccaggaauuuuucucugaccac

SEQ ID NO: 140913 - RNA, 83 nt, Human
cugugcucuugauaacagaguguuugagggacaacuuucacauuugaguuuuuccaaaauuaaagguuguagaagagucacag

SEQ ID NO: 140914 - RNA, 109 nt, Human
gggauagcucauuuuugaaaucaguuuagaacauuuaaaaugugggaaauucaaauaaaaaugcaaauuuucacuguuuucuaaaaagucagaucaacauugcuggccc

SEQ ID NO: 140915 - RNA, 81 nt, Human
ggcuuuaucucuugccuugaccuccuacauuaucaacaaagugagaguuuaagaucuccugggcaggagauuucagaagcc

SEQ ID NO: 140916 - RNA, 109 nt, Human
ugaaucacuguggaaaacaucaguaauucaacaaccuugcugcugaccucuuauucaguuaaaugagagcaaguguugaaacagcugguggugguucacaucaaaauca

SEQ ID NO: 140917 - RNA, 109 nt, Human
guaagggacuugaguauacuuggauuuuugguaucuguggguuggggggacgguccaggaaccaauaccccauggauaccaagggacaacuguacuuauuuaccuuuau

SEQ ID NO: 140918 - RNA, 84 nt, Human
cuguacaaagcagccuuggaccaggagggaaaaccccaaggcucugcagccucccugcuccccuccguuuaaggcuguggucag

SEQ ID NO: 140919 - RNA, 102 nt, Human
aaugcuggacauuuaucuggagcugcaggggguaaagugucauccuugggaaauucaaagcuggccuguaccugcugagagcaccagggauauggucacauu

SEQ ID NO: 140920 - RNA, 127 nt, Human
uuuuguuuguuucuuuguucaacucagguaaccacaucaaauucaaucaccaugucccucuaauaucuucugguuaaucacaguuuggguuccugcugucuucccauugaauauucuauaaaugaaa

SEQ ID NO: 140921 - RNA, 88 nt, Human
ggagaaucacuugaacccaggagacggagguugcagugagcccagaucgcgccacugcacuccagccugggcaacagaauaagacucc

SEQ ID NO: 140922 - RNA, 106 nt, Human
uuaaguaauucugaauuggcuuuugaaagucugcgagaggcugggcaccauggcucacaccuguaauccuagcacuuugggaggccaaggccagaggguugcuuga

SEQ ID NO: 140923 - RNA, 102 nt, Human
aaguaauucugaauuggcuuuugaaagucugcgagaggcugggcaccauggcucacaccuguaauccuagcacuuugggaggccaaggccagaggguugcuu

SEQ ID NO: 140924 - RNA, 76 nt, Human
uagaaaugagagaugagagguccucuggguaaguggggaacuguuuggucucaucgccuccauuucuacaucucua

SEQ ID NO: 140925 - RNA, 88 nt, Human
aggucucauuuuguugcccaggcugggguacaguggugcaaguauggcucacugcagccuugaacucuuucugggcucaagugauccu

SEQ ID NO: 140926 - RNA, 91 nt, Human
aggucucauuuuguugcccaggcugggguacaguggugcaaguauggcucacugcagccuugaacucuuucugggcucaagugauccuccu

SEQ ID NO: 140927 - RNA, 97 nt, Human
guguauggugaguugauguugucccugacuuagggaauauuuauaaacaagggcagagguauccccuggacauguuagggacagcgcuuuaauggac

SEQ ID NO: 140928 - RNA, 92 nt, Human
cagaugccuccuucgggagccacaggauccagagagucaaugaaaguaaaacuucaggacugucuggauuuauuacgccagggaggaaguug

SEQ ID NO: 140929 - RNA, 80 nt, Human
ggguuaggauuuacuugugcuguuucugggaauuaacuugauuauuaacugcccagugaaacggccaaggaagacugccu

SEQ ID NO: 140930 - RNA, 68 nt, Human
cauagcugucuggaggcgcaguuuucagaaaccauagacaucugagaaauauguuucuggcuuuuaug

SEQ ID NO: 140931 - RNA, 88 nt, Human
ggagaauggcgugaacccgggaggcggagguugcagugagccgagauugugccacugcacuccagccugggcaacagagcgagacucc

SEQ ID NO: 140932 - RNA, 102 nt, Human; identical to SEQ ID NO: 140673

SEQ ID NO: 140933 - RNA, 97 nt, Human
guggacuuugauguguguguaggaaaauauuaaggugggauguguggaucaguguccuagcacauucccgcaggguguaagccuggcacuaucauac

SEQ ID NO: 140934 - RNA, 86 nt, Human
ugauguguguguaggaaaauauuaaggugggauguguggaucaguguccuagcacauucccgcaggguguaagccuggcacuauca

SEQ ID NO: 140935 - RNA, 97 nt, Human; identical to SEQ ID NO: 140933

SEQ ID NO: 140936 - RNA, 86 nt, Human; identical to SEQ ID NO: 140934

SEQ ID NO: 140937 - RNA, 93 nt, Human
agugagucucaaggucugauguguauuauaagggggaguuuucauacacaaacucucuuugccugcugccauccauguaagacaugacuugcu

SEQ ID NO: 140938 - RNA, 93 nt, Human
ggggaccguggggugcuauaaauuaggcagccucccuuguaccauugucucagcuauugcuggacucugcugccugucugcccccuguuccuc

SEQ ID NO: 140939 - RNA, 87 nt, Human
uuggcccucucugagucugagagaguaggugugcaauaagaguuaacauuugcuaacuugcagucuuauggcuccuuacagggcuga

SEQ ID NO: 140940 - RNA, 97 nt, Human
agauccgugguccuuggagguuuuagggaaugaacaaauagaggccaguauuaggaggcuuagcuccagagauucuagaccuuggggucagggaucu

SEQ ID NO: 140941 - RNA, 82 nt, Human; identical to SEQ ID NO: 140626

SEQ ID NO: 140942 - RNA, 106 nt, Human
agguugguaaaagugguuucuaacacaguaucucuucuuuuagguguucaguggaaucacacuuacaaaauuuggagggauugugguguuggcuuuugccaaaucu

SEQ ID NO: 140943 - RNA, 49 nt, Human
aauggcuagguaagggaagaugcauucauuuauucauucaacuaauauu

SEQ ID NO: 140944 - RNA, 94 nt, Human
agcccuaauaucuauaauuugaacuguacuggacccauaguuuuaacugaaaagggccaaacaaguggugucuguccaguuccuggacugggcu

SEQ ID NO: 140945 - RNA, 82 nt, Human; identical to SEQ ID NO: 140508

SEQ ID NO: 140946 - RNA, 88 nt, Human
ggagaaucgcuugaacccaggagguggagguugcagugagcugaggucacaccacugcacuccagccugggcaacagagcgagacucc

SEQ ID NO: 140947 - RNA, 73 nt, Human
gcuugaaccugggauguggagguuguagugagcugagauugggccauugcacuccagccugggcaacaagagc

SEQ ID NO: 140948 - RNA, 101 nt, Human
ggacuacaggcacaugcaaccacgucuggcuaauuuucuugaguuuuaguagagacugggucucguuauguuguccaggcuggucccgagcuccugaguuc

SEQ ID NO: 140949 - RNA, 82 nt, Human
ggcaugguggugcucugauagcccuagcuacucaggaggcugagccuaguaguuagaggcugcagugaacuaugauugugcc

SEQ ID NO: 140950 - RNA, 83 nt, Human
ucccuaucacgugcagcuuugcugacgucauugagagauaaauuagguacaagugggcagagaauuguaugugagguuaggga

SEQ ID NO: 140951 - RNA, 101 nt, Human; identical to SEQ ID NO: 140948

SEQ ID NO: 140952 - RNA, 82 nt, Human; identical to SEQ ID NO: 140508

SEQ ID NO: 140953 - RNA, 107 nt, Human
uuugauagauuuuucccuccagaauguuugcaucuauucacaugugcaucagcagugcauuuguaguuaaauguguaguuaacguucuguuuuuaaaacuauacaaa

SEQ ID NO: 140954 - RNA, 70 nt, Human
cagaauguuugcaucuauucacaugugcaucagcagugcauuuguaguuaaauguguaguuaacguucug

SEQ ID NO: 140955 - RNA, 112 nt, Human
guggguauucagagagagaagauaaugaauagggagugucagaaugccagcaucauuugccucaaaugccacuuguuacgugcuuccacucuuuuauucucucugaggacau

SEQ ID NO: 140956 - RNA, 80 nt, Human
gugagcugggguucccauccgauuuucaauucuucuguccauagaccugaagcaaaggauggggggccccacagccuuac

SEQ ID NO: 140957 - RNA, 108 nt, Human
gccaggggugaauuaauguguaguguuuguaaauguguguuuucccccaaaaauguggacccgcaugcccagcacaagugcaagugucaguuuucuugaauuccuggc

SEQ ID NO: 140958 - RNA, 80 nt, Human
ccagagagucucuccagguacgccacacagucuuugagcugugucagagcuggauuguuuaccuggggcuggcuguuugg

SEQ ID NO: 140959 - RNA, 90 nt, Human
ccacguggauuacugggcuccucucaguguggaagcugauuuccaacaaggagcauucaaagauuaggaguucccaguguucauaagugg

SEQ ID NO: 140960 - RNA, 108 nt, Human
gcaucuugacacauguucugugcuccaggucccaguaacugugcccauccauuguuaccacaggucacaguggcccuggcccuggggcauuauacucucucuuggugu

SEQ ID NO: 140961 - RNA, 89 nt, Human
ggaagugaaagagggaagucucucuccccaucccuccucucaguuaccaugaggaugggcaguuucuucccuuuccguucuucacuuuc

SEQ ID NO: 140962 - RNA, 101 nt, Human; identical to SEQ ID NO: 140948

SEQ ID NO: 140963 - RNA, 97 nt, Human
guuuggugccuauuggauuuuaagcauugggaguugaccuuuauauaaaacaaaaccccuaagcuuauaauucaguagggagaaacagacaguaaac

SEQ ID NO: 140964 - RNA, 90 nt, Human
guuuggugccuauuggauuuuaagcauugggaguugaccuuuauauaaaacaaaaccccuaagcuuauaauucaguagggagaaacagac

SEQ ID NO: 140965 - RNA, 71 nt, Human
uugcuugaacccgggagguggagguuguagugagccgagaucgcgccacugcacuccagccugggcaacag

SEQ ID NO: 140966 - RNA, 101 nt, Human; identical to SEQ ID NO: 140948

SEQ ID NO: 140967 - RNA, 82 nt, Human; identical to SEQ ID NO: 140508

SEQ ID NO: 140968 - RNA, 105 nt, Human
uauugguuucauucuugguaaagaaaucauaaaaguccaggacagaaagugaccuauagggaugaccuggccucuugcccuuuucuuugcuucuggaaagcagua

SEQ ID NO: 140969 - RNA, 73 nt, Human
auguuaugauuguuucauuuguuggaaauaaggaaaacuugcaugguuugaauuguggaacaauagguggugu

SEQ ID NO: 140970 - RNA, 87 nt, Human
gagaauugcuugaacccuggagguggagguugcagugagccgagauugcaccauugcacuccacccuaggcaacaagagcaaaacuc

SEQ ID NO: 140971 - RNA, 89 nt, Human
uccaaaccauauaaucuucuguugcgggaagucagggaccccaaacggagggaccggcugaagccaugacagaagaacguggauuguga

SEQ ID NO: 140972 - RNA, 88 nt, Human
aggaagauugugugaguccaggaauuggaggcugcagugagcuauaauugugccaacuguacuccagccugggcaacaguuagacccu

SEQ ID NO: 140973 - RNA, 131 nt, Human
uggguuggcugcuugugaauuugugggugaggagcggcugcagggugacuagagagaucugccgcggucaagaugcuggacuagccgcuuugucauuuuaauuuccacccggguugccaggcaccgccaca

SEQ ID NO: 140974 - RNA, 83 nt, Human
gccccugcccaagagauccacuuuauuuucaucucacccagaauauugaggugaucagcaagguggagugguugggagagggu

SEQ ID NO: 140975 - RNA, 82 nt, Human; identical to SEQ ID NO: 140508

SEQ ID NO: 140976 - RNA, 108 nt, Human
gcuucacuuucaggggcaagguuugggaaauaagcugauaguaaagucauguaacacuuucugugcagguuaacauuucuggaccuugcuuuccuucucaguguaugc

SEQ ID NO: 140977 - RNA, 113 nt, Human
gauucacaucaccuggauauaaggcccggugauacguuacaauuccccugugagcagcgcuaaagcagaagaauaggguaauaucaccuaggggcugaguccagugauauguc

SEQ ID NO: 140978 - RNA, 106 nt, Human
agggugcuguugcuucuaggucuuuugagagcauagagccaggaagcauacacacauuuuuggcuccugacuuuuugcucuuucccagguuauugaguuugccccu

SEQ ID NO: 140979 - RNA, 82 nt, Human; identical to SEQ ID NO: 140508

SEQ ID NO: 140980 - RNA, 97 nt, Human
cgaaccagguagaaguaaugugugccaggacaagagacgcacccagagccucuggccuuggucuccuauccuggcucacaagcacacuccaaguuug

SEQ ID NO: 140981 - RNA, 93 nt, Human
gucuaacuagucccagugagauaagccggguaccucaguuugaaaugcagaaaucacucaccuugucuguugaucucgcugggagcugcagac

SEQ ID NO: 140982 - RNA, 94 nt, Human
uaugucaccaaauuuggugugcuuucuccuuugccugcugcuucuuucaaguaggacauggagacaacagccaaauuugugcuucagugaugug

SEQ ID NO: 140983 - RNA, 71 nt, Human
caaauuuggugugcuuucuccuuugccugcugcuucuuucaaguaggacauggagacaacagccaaauuug

SEQ ID NO: 140984 - RNA, 94 nt, Human
cuccuuagguuuuaucaauccuggugcccuuccauuguaucacauccuuggaucacagugauggguucaggaauagacacaugacccaagggag

SEQ ID NO: 140985 - RNA, 89 nt, Human
ccuuagguuuuaucaauccuggugcccuuccauuguaucacauccuuggaucacagugauggguucaggaauagacacaugacccaagg

SEQ ID NO: 140986 - RNA, 106 nt, Human
ggccacacuuguaaccccagaggcauugauuuuucugguggcauggucugcuggguguaugaucaugaagccacaagaaucccaagucugucugcuuuuguguguc

SEQ ID NO: 140987 - RNA, 107 nt, Human
ggccacacuuguaaccccagaggcauugauuuuucugguggcauggucugcuggguguaugaucaugaagccacaagaaucccaagucugucugcuuuugugugucu

SEQ ID NO: 140988 - RNA, 101 nt, Human
gagcuguccgugacguagguuuguacgucaacucagccuuauucugggaaaucauuaauccuuaacucugaugacugugcaaaaguagucacugaccacuc

SEQ ID NO: 140989 - RNA, 83 nt, Human
gugacguagguuuguacgucaacucagccuuauucugggaaaucauuaauccuuaacucugaugacugugcaaaaguagucac

SEQ ID NO: 140990 - RNA, 88 nt, Human
ggagaauugcuugaacucaggaggcggaaguugcagugagcugagaucgcaccacugcacuccagccugggcaacagagugagacucc

SEQ ID NO: 140991 - RNA, 81 nt, Human
ggaccauugaggagguggggcagcagcaggacccccagaaccgaagccugugucucugcugucucaucccuucauucuucc

SEQ ID NO: 140992 - RNA, 82 nt, Human; identical to SEQ ID NO: 140508

SEQ ID NO: 140993 - RNA, 83 nt, Human
aguuuaagaauggcucauguaguacccagcuacucugggcgacugagcccaggguacucugggaucacuugagcccaggagcu

SEQ ID NO: 140994 - RNA, 81 nt, Human
guuuaagaauggcucauguaguacccagcuacucugggcgacugagcccaggguacucugggaucacuugagcccaggagc

SEQ ID NO: 140995 - RNA, 103 nt, Human
gugccuagccaagcagaugaaugagguagaacagucuuguucauacauugccauuauaucuagugcaguugaaugaacauuuucugugucugggcuuaggugc

SEQ ID NO: 140996 - RNA, 86 nt, Human
aggaucacuugagcccaggaguuggaggcugcagugagcuaugauugcacuacugcacuccagccugggcaacagagcaagauccu

SEQ ID NO: 140997 - RNA, 73 nt, Human
cucuugaacccaggaaguggagguugcagugagcugagauagcaacacugcacuccagccugggcaacaagag

SEQ ID NO: 140998 - RNA, 75 nt, Human
uuggcucagaaugggacaugggacuuuguaauuaggucuaucccagaauuacaaccuuugcccauacuaagcugg

SEQ ID NO: 140999 - RNA, 90 nt, Human
aagcaugaagaggacggggcgcucagguuuggaugaauuagcuuuugaaagugaguuuuccacaucugauaaauccuucccuuuccccuu

SEQ ID NO: 141000 - RNA, 106 nt, Human
gcuugaccuugggaaggguggagacagagaaacuaaggccauccaaaugggugcucuuguccaugugaccaaccuccaguaaaacccucaaccccaaggcucaggu

SEQ ID NO: 141001 - RNA, 91 nt, Human
ggagaaucgcuugaacccgggggguggagguaguggugagccgagcuugcacaccauugcacuccagccugggcaacaagagagaaacucc

SEQ ID NO: 141002 - RNA, 82 nt, Human; identical to SEQ ID NO: 140508

SEQ ID NO: 141003 - RNA, 106 nt, Human; identical to SEQ ID NO: 141000

SEQ ID NO: 141004 - RNA, 77 nt, Human
uaucucaucugguuuuaauccugaaggcauauauguaugacauuaucugucuuuagggaggagacccaacagaggua

SEQ ID NO: 141005 - RNA, 82 nt, Human; identical to SEQ ID NO: 140508

SEQ ID NO: 141006 - RNA, 77 nt, Human
acagcucaccugcaaggcuuucaacucugcugaccuucagagugucagagcagugccgaagcccaggacauggcugu

SEQ ID NO: 141007 - RNA, 86 nt, Human
ggccuucucucugaguuaagcaaagagaggaagaauggcaaauaguuugagucuucccaaaucuuuuuagcauuugagaaaaggcu

SEQ ID NO: 141008 - RNA, 87 nt, Human
acugaagccuccugccaauagucacaugagugagucuggaagugaaucuuucagcaccaucagaugacuguaucacuggcuuacagu

SEQ ID NO: 141009 - RNA, 106 nt, Human
uauuccagauuucuuaguuuugcucagcaggaugguuggacugaagggggcugguuuacuucuucaguggaaguguucauuuuugcaaauacuaguuacuggaaua

SEQ ID NO: 141010 - RNA, 103 nt, Human
ccaagucaauucuggagaccugggugugggucaagcaaccagguaaucugaguuuuggcacuuuggaaagcuugaucugacgcuccuuuucuaaauaacuugg

SEQ ID NO: 141011 - RNA, 83 nt, Human
gagacugguacagauggggucuccuggauguaacgaguucuugcugcuuuaacuggauccgguugacucugucugaccagcuc

SEQ ID NO: 141012 - RNA, 111 nt, Human
ccagcugccacccuucuacccaaccccaucucauagaacucacaacaaccuuguugggagaaaaggaggggauacaggggcuuaaagagggggaaauaaccauauagcugg

SEQ ID NO: 141013 - RNA, 82 nt, Human; identical to SEQ ID NO: 140508

SEQ ID NO: 141014 - RNA, 88 nt, Human; identical to SEQ ID NO: 140946

SEQ ID NO: 141015 - RNA, 73 nt, Human
acccacauucuuagcuuggcuucaguuucuuuccgggucuuacugagaggugaagccaggcuucugggugggu

SEQ ID NO: 141016 - RNA, 110 nt, Human
uucacccucucagccaggcuggucuugaacuccugacuuugugauccaccugccuuggccacccaaagugcugguauuacaagugugagccaccgcgccuggccggugaa

SEQ ID NO: 141017 - RNA, 111 nt, Human
gcucugucuugagaaucgagaaauauggggcucuuuucugucuuugcgauuuuggcuaucaauuuguagcagaacacuggguccaguuucuucauuaucucuuuacugagc

SEQ ID NO: 141018 - RNA, 103 nt, Human
ccuccuugaguuuuaacagcaacaaacagcuacuuucuucuuguugucuuuggucccacagcucauaaacagcagguagagauagcguuuuauugcugggagg

SEQ ID NO: 141019 - RNA, 87 nt, Human
aggaucacuuaaggcccaggaguucgaggcuguagugagcuaugacugugucacugcacuucagccugggcaauggagcaagauccu

SEQ ID NO: 141020 - RNA, 92 nt, Human
ggagaauagcuugaaccugggagguggagcuuacagugagccaccgagauugugucauugcacuccagccugggcaacaagagcaaaucucc

SEQ ID NO: 141021 - RNA, 90 nt, Human
caccugucaugccaguuacuuggggggcuaaggugggaggauuagugagcugugauucugccacugcauuccagccugggugacagagug

SEQ ID NO: 141022 - RNA, 74 nt, Human
uggaggaaguaguggcuguguuagacuaaccaagaaucccuguaguucacucacagccuguacacuguccuuca

SEQ ID NO: 141023 - RNA, 105 nt, Human
uagaagcaucuuuaguuuuaaggaagugucucuuggcuggccccuagauagcuuuaggaugggagcuagucaccagaaacaccaauccuugauuagaagcuugua

SEQ ID NO: 141024 - RNA, 90 nt, Human
cuuuaguuuuaaggaagugucucuuggcuggccccuagauagcuuuaggaugggagcuagucaccagaaacaccaauccuugauuagaag

SEQ ID NO: 141025 - RNA, 87 nt, Human
uuuaguuuuaaggaagugucucuuggcuggccccuagauagcuuuaggaugggagcuagucaccagaaacaccaauccuugauuaga

SEQ ID NO: 141026 - RNA, 101 nt, Human
ggaacaguacacucacggcacccuggagaggagcggucacugguugcugagugaauuaaccgaauguuugcugcuuuucuccugcaacaguucauuauucc

SEQ ID NO: 141027 - RNA, 131 nt, Human
gcuucaucauccugguucaagcaguguuucuucucuaucaggccugguggcuguuguuuugggcuccccaaggcgagaggcggcccuggacaaguggguuggaagacacggugaccagagaagagggaagc

SEQ ID NO: 141028 - RNA, 102 nt, Human
gagugaccccaucucuacaaaaaguuuuuuuaaauuagcuaggcauggugguauacacuuguaguccuagcuacuuaggaagcugaggcaggagggucacuu

SEQ ID NO: 141029 - RNA, 88 nt, Human; identical to SEQ ID NO: 140603

SEQ ID NO: 141030 - RNA, 112 nt, Human
uucugugauggguguacgacagauuauuuugugacugcagucuguucaaaucacaucacuaagcagcgcugagaugauuuguuggugcauuaaaagguuuugcaucauggaa

SEQ ID NO: 141031 - RNA, 88 nt, Human; identical to SEQ ID NO: 140603

SEQ ID NO: 141032 - RNA, 76 nt, Human
uccaucaaagcucuccuaucagcugggcgugguggcucauaccuguaaucccagcacuuugggaggcugagguggg

SEQ ID NO: 141033 - RNA, 72 nt, Human
gacacugcugugguuggaauaggucuuccaaagcucauguguugaaaacuuaauccccacugcaguaguguu

SEQ ID NO: 141034 - RNA, 100 nt, Human
ugaggcaggagaauugcuugaacuugaaaggcagagguugcagugagccgaaauugcaccacugcacuccagccuggcgacagagcaagacuccaucuca

SEQ ID NO: 141035 - RNA, 98 nt, Human
gaggcaggagaauugcuugaacuugaaaggcagagguugcagugagccgaaauugcaccacugcacuccagccuggcgacagagcaagacuccaucuc

SEQ ID NO: 141036 - RNA, 89 nt, Human
ggagaaucacuugagcccuggaggcagaagaugcagugagccugggucaugccacugcacuccagccugggcaacaagagugagacucc

SEQ ID NO: 141037 - RNA, 85 nt, Human
gcuguccuggagcuguuggagaaauggggaagaucaucuagauauuccaguuucuccuuccacucacccuauaguaccggauagc

SEQ ID NO: 141038 - RNA, 88 nt, Human; identical to SEQ ID NO: 140603

SEQ ID NO: 141039 - RNA, 112 nt, Human
gggugugguggagcacgccuguuaucccagcuacucaggaggcugaggugggagaaucaccugagcccgggagguagagguugcagugaguggagaucgugucaccacacuc

SEQ ID NO: 141040 - RNA, 108 nt, Human
gugugguggagcacgccuguuaucccagcuacucaggaggcugaggugggagaaucaccugagcccgggagguagagguugcagugaguggagaucgugucaccacac

SEQ ID NO: 141041 - RNA, 77 nt, Human
uuguggucuugcugauuuugagaauggagccccagaccuuccugguguuacagcucucaaagaagacaaggacccaa

SEQ ID NO: 141042 - RNA, 86 nt, Human
ggagaauugcuugaaccuggaggcggagguugcagugagccgagauugugccacugcacuccagcccggcaacagagcaagacucc

SEQ ID NO: 141043 - RNA, 105 nt, Human
ggauacauaguggucacuuccauuuaagauguuugcauuucagcacuuuuauaauucaaauauggugcugucccuugagacucuuguugagagccacauguaucu

SEQ ID NO: 141044 - RNA, 103 nt, Human
gauacauaguggucacuuccauuuaagauguuugcauuucagcacuuuuauaauucaaauauggugcugucccuugagacucuuguugagagccacauguauc

SEQ ID NO: 141045 - RNA, 78 nt, Human
gggggccacauucucugggcauucagaagccaggauuucauaggccaugaaaucugcugucuuuuagaagugggcucc

SEQ ID NO: 141046 - RNA, 110 nt, Human
cccuaaaagugacugaauugcccaagugcuugaacauggcagagguaguuacuccuauuuugcaguuugugcacuuaaaaauuccuacagugauuguuacuuuacugggg

SEQ ID NO: 141047 - RNA, 82 nt, Human; identical to SEQ ID NO: 140508

SEQ ID NO: 141048 - RNA, 90 nt, Human
gggacaaggcaaaugagagaggaaggccguagggaagggcuucucuccuaccucccacgucuuuaucuguccaaauccuugcuauuuccc

SEQ ID NO: 141049 - RNA, 122 nt, Human; identical to SEQ ID NO: 140519

SEQ ID NO: 141050 - RNA, 113 nt, Human
ugggcugagggaaagcauguccacaccaggugcccagacaucugguuggcuuuggcugauuuguccugcaggcaccugccuugucuggauuugcacacuuuccaaguugccca

SEQ ID NO: 141051 - RNA, 114 nt, Human
gggagcucuuuugcaaaacaaaagaugucuucuuuucccuuagcccuugguuuuguuuggcagaugguguaggugaagagaacauuaguuguggaagagguauguaugacuccc

SEQ ID NO: 141052 - RNA, 94 nt, Human
cucuuuugcaaaacaaaagaugucuucuuuucccuuagcccuugguuuuguuuggcagaugguguaggugaagagaacauuaguuguggaagag

SEQ ID NO: 141053 - RNA, 112 nt, Human
cggugagauggcugaaagguagacaucgagaaguuuuaauauucagaaucuuuucuucucaagacgcugaauguaaucuuaguuguaaauacccaucaccugccagucaccg

SEQ ID NO: 141054 - RNA, 82 nt, Human; identical to SEQ ID NO: 140508

SEQ ID NO: 141055 - RNA, 102 nt, Human
ugaggcaggagaaucgcuuuaacccgggaggcagagguuguggugagccgagaucgcgccauugcacuccagccugggcaacaagagcggaauucugucuca

SEQ ID NO: 141056 - RNA, 100 nt, Human
gaggcaggagaaucgcuuuaacccgggaggcagagguuguggugagccgagaucgcgccauugcacuccagccugggcaacaagagcggaauucugucuc

SEQ ID NO: 141057 - RNA, 130 nt, Human
caggcagcaggaugaucucuuguggaguaaaaugucagguguuuuuuuuuuuaagaaaucgauuuuuaguugugacgucauuuggcaggcuguccacgguaucacuuucugcuuauuuuuaaaaggucug

SEQ ID NO: 141058 - RNA, 101 nt, Human
ugaggccugagaauugcuugaacccaggagguagagguugcagugagcugagaucgcaccacugcacuccagccugggcaacagagcuagacucugccuca

SEQ ID NO: 141059 - RNA, 99 nt, Human
ccacugggcagcuggcaauucucugguagggguagccuucugcagaggcuggcuagcagaccaggcaccucucccagacugccuuuuguuuauagcugg

SEQ ID NO: 141060 - RNA, 90 nt, Human
cagcuggcaauucucugguagggguagccuucugcagaggcuggcuagcagaccaggcaccucucccagacugccuuuuguuuauagcug

SEQ ID NO: 141061 - RNA, 107 nt, Human
ugcuaaagaaagaggggcugauuugucagacuauuuugucuauaacuaggguagccauauaugccaauuuccccaaggcagucuugauuagcuucuauuuuuuggca

SEQ ID NO: 141062 - RNA, 96 nt, Human
ggcaggagaaucacuugaacccaggaggcagagguugcagugagccaagaucaugccacugcacuccagccugggcaacaagaaugaaacucuguc

SEQ ID NO: 141063 - RNA, 101 nt, Human
ugaggcaggagaauggcgugaacccgggaggcagagcuugcagugagcccagauugcgccacugcacuccagccugggcaacagagcgagacuccgucuca

SEQ ID NO: 141064 - RNA, 99 nt, Human
gaggcaggagaauggcgugaacccgggaggcagagcuugcagugagcccagauugcgccacugcacuccagccugggcaacagagcgagacuccgucuc

SEQ ID NO: 141065 - RNA, 93 nt, Human
gaucauaagcucccugaaaacacguugcaucugugucucuagcaacuuccacaaauguuuggagaauaaauuaauguguggcagggcgcgguc

SEQ ID NO: 141066 - RNA, 103 nt, Human
cugaggcaggagaauggcaugaacccaggagguggagcuugcagugagccgagaucacgccacugcacuccagccugggcaacacagcgagacuccgucucag

SEQ ID NO: 141067 - RNA, 101 nt, Human
ggucguuugcuuuucagugaccagguucuucauacacauggaugucucacagaucagcuaaggccuguguuugaacaccuuggucaccccugcaaggagcc

SEQ ID NO: 141068 - RNA, 91 nt, Human
gcaaugugccaagcuucucuguaggcccuggggugccacagugaacaagacaaaugggaacccuguuuacagggagguuacugguuauugu

SEQ ID NO: 141069 - RNA, 78 nt, Human
gccaagcuucucuguaggcccuggggugccacagugaacaagacaaaugggaacccuguuuacagggagguuacuggu

SEQ ID NO: 141070 - RNA, 82 nt, Human; identical to SEQ ID NO: 140508

SEQ ID NO: 141071 - RNA, 98 nt, Human
caggcaaagguggcuuaaugaagagcaagggguuuuuagaugacauggugguaguguuauuaauaaacucuuuuuccucuuuaugcagcugguuccug

SEQ ID NO: 141072 - RNA, 74 nt, Human
ucacgacacaauugcagggagagccauucauguaaaugacaaugucugugguucucccuggagcugugcaguga

SEQ ID NO: 141073 - RNA, 98 nt, Human
gagacaggggaaucgcuugaaucugcaagguggagguugcagugagcugagauugugccacugcacuccagccuggcaacagaaugagacucuaucuc

SEQ ID NO: 141074 - RNA, 108 nt, Human
cuggucuggcagcacuaagaggcaggcauucuggguaucagacauaaauccccucccaggaacuuuuguguccugacccagaggacuggcucuugagaaugagaacag

SEQ ID NO: 141075 - RNA, 80 nt, Human
uaagaggcaggcauucuggguaucagacauaaauccccucccaggaacuuuuguguccugacccagaggacuggcucuug

SEQ ID NO: 141076 - RNA, 78 nt, Human
aagaggcaggcauucuggguaucagacauaaauccccucccaggaacuuuuguguccugacccagaggacuggcucuu

SEQ ID NO: 141077 - RNA, 103 nt, Human
ggauuagaugauggugacagcaguagcagcaggagcagguaacauucauuuagaguugagaugugccacacccugcucuaaaugcuuuauggauaucaagucc

SEQ ID NO: 141078 - RNA, 99 nt, Human
gcugcuuuccuaucuuacccuuccugcucuccuuuuuguagugaugaggaacaaugaaaaagagguaguguaaggaauugugaggcugggcaugguggc

SEQ ID NO: 141079 - RNA, 113 nt, Human
agagagaaaaaguaaguagucuguagucuguagcuuguuaagugucagagccuggcuuugaacccagaacucuagcuccacagcuggcauuccuaacuacucuuuugcucucu

SEQ ID NO: 141080 - RNA, 90 nt, Human
aggaggaggggagaggccagagagagaagcggcuuucgggaaggaaagugugaucuaguagguggaauaguccucuccaaacuuugaccu

SEQ ID NO: 141081 - RNA, 74 nt, Human
ggaggggagaggccagagagagaagcggcuuucgggaaggaaagugugaucuaguagguggaauaguccucucc

SEQ ID NO: 141082 - RNA, 82 nt, Human; identical to SEQ ID NO: 140508

SEQ ID NO: 141083 - RNA, 79 nt, Human
cugaggcuggaguauaaugguaugaucuuggcucacugcaaccucugccuccaggauucaagcgauucuccugccuuag

SEQ ID NO: 141084 - RNA, 109 nt, Human
agagucaccuaugaagcauuaaaauaauuaaagugucugaggccuuccccuucaauaaaucugggauugggcccaggcaacuguguuuuuuaagcacccagguuauucu

SEQ ID NO: 141085 - RNA, 80 nt, Human
gcauuaaaauaauuaaagugucugaggccuuccccuucaauaaaucugggauugggcccaggcaacuguguuuuuuaagc

SEQ ID NO: 141086 - RNA, 101 nt, Human
ugaggcaggagaauugcuugaacucgggaggcggauguugcagugagccaauaucgcaccacugcacuccagccugggcaacagagcaagacuccgucucg

SEQ ID NO: 141087 - RNA, 88 nt, Human
ggagaauugcuugaacucgggaggcggauguugcagugagccaauaucgcaccacugcacuccagccugggcaacagagcaagacucc

SEQ ID NO: 141088 - RNA, 77 nt, Human
ccauguuaauuuccugguagugaugacagcacugugauuauauaggaguguguccuugguguuugggaauuacaugg

SEQ ID NO: 141089 - RNA, 76 nt, Human
uugcuugaacccgggagguggagauugcagugagcugagaucaugccacugcacuccagccugggcgacagagcaa

SEQ ID NO: 141090 - RNA, 114 nt, Human
gagaagauaaaugcguuuucagggaugucaucuugggccugcuuuucucugaucguguagcgaugggcucauuuugcagugauuuauaccugauggccgugaaccuaucuucuc

SEQ ID NO: 141091 - RNA, 100 nt, Human
gaaggcagagucuugcucugucacccaggguggaaugcaguggcacgaucuuggcucacugcgaccucuaucucuuggguuaaagcaauucuccugccuc

SEQ ID NO: 141092 - RNA, 97 nt, Human
aggcagagucuugcucugucacccaggguggaaugcaguggcacgaucuuggcucacugcgaccucuaucucuuggguuaaagcaauucuccugccu

SEQ ID NO: 141093 - RNA, 85 nt, Human
guauggggcaacuuggggcgugaugucagccagaguccuuccaccaaggcuuuuaugguguuacgugauccaccaccccauuaac

SEQ ID NO: 141094 - RNA, 82 nt, Human; identical to SEQ ID NO: 140508

SEQ ID NO: 141095 - RNA, 107 nt, Human
gcccuuagaaauuguuaugauugucccagaaauccaggcuuaaaugauacucagguguaauauucaagauaagggucugggagaauauaaaauauuaauuugagggu

SEQ ID NO: 141096 - RNA, 73 nt, Human
gguuggaaugaggaaggguguggucuucggcuaaaauuugcauaaaacggaacccauccgggcgauuccaacu

SEQ ID NO: 141097 - RNA, 113 nt, Human
uucuaaagcuuugguacuagaauaguagagugauuaagaguagaggcuuugagauaaauaaaccuggcuucaagucucugcuuuacaacuuacuaucugggucaucuuaggaa

SEQ ID NO: 141098 - RNA, 94 nt, Human
ggugguaaagcccuggagugaggcaggaaccccaaagcccuaugacaccccauauagguacccccaaaccugccuauacuucaggccaggcccc

SEQ ID NO: 141099 - RNA, 95 nt, Human
ggugguaaagcccuggagugaggcaggaaccccaaagcccuaugacaccccauauagguacccccaaaccugccuauacuucaggccaggccccc

SEQ ID NO: 141100 - RNA, 112 nt, Human
ugcuacguuauuuuguuuugacauuaaaaaugccaucucuguggucucagugcaacauugucuagagaacuuuuggagaagguaugggggugcaugaaauagauaaguggca

SEQ ID NO: 141101 - RNA, 110 nt, Human
gcuacguuauuuuguuuugacauuaaaaaugccaucucuguggucucagugcaacauugucuagagaacuuuuggagaagguaugggggugcaugaaauagauaaguggc

SEQ ID NO: 141102 - RNA, 99 nt, Human
ggaaaagaaccauggguuaggccuuuuugggaagagacaguucagcuuuugauguaaaacagcuguaccuucugagagagguagccccaugucuucauc

SEQ ID NO: 141103 - RNA, 89 nt, Human
cacugugggguuuuucagcaguggaagagggaucugauuucccugagaaggaucucuuugucauguugagaacugaugccuagaaagug

SEQ ID NO: 141104 - RNA, 95 nt, Human
ggugucagagagggacuagggcuucaagcagacccuggauggagauuacucugcuacugaauaaaacccuagcuuauuucucucucuggauuucu

SEQ ID NO: 141105 - RNA, 85 nt, Human
ucagagagggacuagggcuucaagcagacccuggauggagauuacucugcuacugaauaaaacccuagcuuauuucucucucugg

SEQ ID NO: 141106 - RNA, 83 nt, Human
cagagagggacuagggcuucaagcagacccuggauggagauuacucugcuacugaauaaaacccuagcuuauuucucucucug

SEQ ID NO: 141107 - RNA, 74 nt, Human
cucagacucaccaaacagucugcuucuuaccccaguguaagcacugaacaggcagguggguguaugggucugag

SEQ ID NO: 141108 - RNA, 98 nt, Human
agggagagucuuggggugaagagguuugagccuucuccugcucuguccguggagcaagucaaauaaaugcugagaccgucagcuccucauuucuccuu

SEQ ID NO: 141109 - RNA, 99 nt, Human
gaggugggaggaucgcuugagcccaggaggucaaggcugcagugaguugugaucaugccacugcacuccagccugggcaacaaagcaagaccccaucuc

SEQ ID NO: 141110 - RNA, 99 nt, Human
accuugaaggagucugguccugugcuggugaaacccacagagacccucacgcugaccugcacucucucuggguucucacucagcacuucuggaaugggu

SEQ ID NO: 141111 - RNA, 81 nt, Human
ucugguccugugcuggugaaacccacagagacccucacgcugaccugcacucucucuggguucucacucagcacuucugga

SEQ ID NO: 141112 - RNA, 82 nt, Human; identical to SEQ ID NO: 140508

SEQ ID NO: 141113 - RNA, 101 nt, Human
ugguuguuaugagucugguuguuaagugcugguuguuaguuguuaaaguagagaaaaccccuagcacagugcuuggcacacacuaaagccaucauaaacca

SEQ ID NO: 141114 - RNA, 106 nt, Human
gggaagaacuaccaaucuagggcacacgucucucugaauuguugauuaugcgcuuuaugaagagauuuuucaaucucgugugcuuuacuuugugugguuuagaccc

SEQ ID NO: 141115 - RNA, 85 nt, Human
gagaauugcuuuaacccgggagguggagguugcagugacugagaucgggccacugcacuccagccugggcaacagagagagacuc

SEQ ID NO: 141116 - RNA, 82 nt, Human; identical to SEQ ID NO: 140508

SEQ ID NO: 141117 - RNA, 99 nt, Human
gaggcgggagaauugcuugaacccgggagguggagguugcagugagccgagaucgcgccauugcacuccagccugggcaacagagcaagacucugucuc

SEQ ID NO: 141118 - RNA, 95 nt, Human
ggcgggagaauugcuugaacccgggagguggagguugcagugagccgagaucgcgccauugcacuccagccugggcaacagagcaagacucuguc

SEQ ID NO: 141119 - RNA, 88 nt, Human
ggagaauugcuugaacccgggagguggagguugcagugagccgagaucgcgccauugcacuccagccugggcaacagagcaagacucu

SEQ ID NO: 141120 - RNA, 76 nt, Human
uugcuugaacccgggagguggagguugcagugagccgagaucgcgccauugcacuccagccugggcaacagagcaa

SEQ ID NO: 141121 - RNA, 76 nt, Human
gccucuggacaauacuguuaaaacuaaauacuugccaggugugguggcucacaccugugauaguucuuuuggaggc

SEQ ID NO: 141122 - RNA, 88 nt, Human
gaaggagcuugggacuuccaagccucuaccucuuauagaaaaggagauugaggcucagagaggggaagugauugguccaagguccuuc

SEQ ID NO: 141123 - RNA, 124 nt, Human
cagacugggaaugggaugaggacuuccauauuaccccaugcauagagauacauuaaacaucccuuaaaaguggguguggccuggaacaugcuggcugguuggaacuuccuuaucauucccuuug

SEQ ID NO: 141124 - RNA, 114 nt, Human
gggaaugggaugaggacuuccauauuaccccaugcauagagauacauuaaacaucccuuaaaaguggguguggccuggaacaugcuggcugguuggaacuuccuuaucauuccc

SEQ ID NO: 141125 - RNA, 82 nt, Human; identical to SEQ ID NO: 140508

SEQ ID NO: 141126 - RNA, 108 nt, Human
aaauagccauucccucgugcugcgacaguuccauuccuaaugcagacuuacaaaaacuagguguaaggcuggcauuagggugaggccaggaugagagcagggcuuuuu

SEQ ID NO: 141127 - RNA, 100 nt, Human
agccauucccucgugcugcgacaguuccauuccuaaugcagacuuacaaaaacuagguguaaggcuggcauuagggugaggccaggaugagagcagggcu

SEQ ID NO: 141128 - RNA, 82 nt, Human
cucgugcugcgacaguuccauuccuaaugcagacuuacaaaaacuagguguaaggcuggcauuagggugaggccaggaugag

SEQ ID NO: 141129 - RNA, 99 nt, Human
ugacccuccagaccucacauuuguucuggagcccauacucaccaaucagcuuuagcuuuuggucgagaugagguuucucgaagggucucugcaggguca

SEQ ID NO: 141130 - RNA, 103 nt, Human
ccuuggcauucauuauuuucauuccaguucucagcacagcgcuuggcacauaguaggaacucaggaaguguuuaugggauggaauggggugaugauguugagg

SEQ ID NO: 141131 - RNA, 99 nt, Human
gagacaggagaaucacuugaaucugagagguggaaguugcagugagccgagauugugccacugcacuccagccugggugacagagugaaacuccaucuc

SEQ ID NO: 141132 - RNA, 82 nt, Human
uggcuucccaaagugcuggcguuacaggugugagccaccgcaccuggccaucccggcauuuuucuauucugcugugaggcua

SEQ ID NO: 141133 - RNA, 101 nt, Human
ucaauacuuuaaaggcacacuugucugcuuucuacacuguugccggagaagggucauaaagugaaguuuggcagaaaaguuuggccauugucuaguacuga

SEQ ID NO: 141134 - RNA, 105 nt, Human
uacggguacuuccaggccauuuuuguuguuucuguggagaauacugaagaauauuucgugucauugccaccugggaaccuuggaagugugguccuggagcucgug

SEQ ID NO: 141135 - RNA, 103 nt, Human
acggguacuuccaggccauuuuuguuguuucuguggagaauacugaagaauauuucgugucauugccaccugggaaccuuggaagugugguccuggagcucgu

SEQ ID NO: 141136 - RNA, 101 nt, Human
gaccuucauguucuaguccuuugaguuuuuuacuaggcugaaacaaaagaaagcgauugguugcuaguaaaagaacugaacaaaggcagacagggaggguu

SEQ ID NO: 141137 - RNA, 84 nt, Human
agaaucgcuugaacccaggaggcacagguugcaguaggccgagauugugccacugcacuccagccuggguggcagagugagacu

SEQ ID NO: 141138 - RNA, 87 nt, Human
cuaucgcaucaacacagucaugcguugcuuaaugacaggggcauguucugagaaucguuaggcgauuuuguugugugaaugucauag

SEQ ID NO: 141139 - RNA, 101 nt, Human
ugaggcaggagaauggcgugaacccgggaggcggagcuugcagugagccgagaucgcgccacugcacuccagccugggcaacagagugagacuccgucuca

SEQ ID NO: 141140 - RNA, 83 nt, Human
auaagccuugucugucagucauuaacugugggcugauccccagucuguccgucauuaaugaacugcaggaacuucgggcugau

SEQ ID NO: 141141 - RNA, 114 nt, Human
ucuuucucuaauuuguccaccaguaguaugcaucuuuuucuccacuagccaggggcuauggaggcccugaauagaacagaagagcagcuagcaagggcggaaggaagagagaga

SEQ ID NO: 141142 - RNA, 102 nt, Human
ugaggcaggagaaucgcuugaacccggaaggcagagguuguggugagcugagauugcaccauugcacuccagccugggcaauaagagcaaaacucugucuca

SEQ ID NO: 141143 - RNA, 96 nt, Human
gauuuugagaacagcugguaauucugauuuccuguuucugcaucccaaagaucaguaucugucaggaauuuggaaacacuuguuguuccuccaguc

SEQ ID NO: 141144 - RNA, 92 nt, Human
aggaugguggagaaaaaagcuagaaggagacuggguaccugauguccguggugcugcccuguuagcucuggacugccuuucuucaaauuccu

SEQ ID NO: 141145 - RNA, 108 nt, Human
cuguugcccaggcuggagugcaguggcaccaucucagcucacuggagcgucugccuccagguucaagugauucuccugccucagcaucccaaguagcugggacuacag

SEQ ID NO: 141146 - RNA, 100 nt, Human
ugagaaggagucucauucuguugccuaggccggagugcagugacaugaucuuggcucacugcaaucuccaccuccagguucaagugauucuccugccuca

SEQ ID NO: 141147 - RNA, 79 nt, Human
gugugacuuuagugcuacucugauuuuacuguucaggaaagugaagcagagagguucaaugucuuacucaaggucacac

SEQ ID NO: 141148 - RNA, 89 nt, Human
gccuugcuuuaagccauguccuguugugggcacgauaauagcaacugagcugucacagccuaccagcaggcugguaacaccuccagggu

SEQ ID NO: 141149 - RNA, 113 nt, Human
cuguccugcuuaacuuccaccacguugacauaaucaaguaucuguagugucgcuacugaacucagccuuuuccauuugucagcugaugguaggaauuagagaaagcugggcag

SEQ ID NO: 141150 - RNA, 93 nt, Human
gacguaugacuguauauagauauacacaucuauccgcauaugugugacugcuaugugugugaugauuugugagucugugugcauccauauguc

SEQ ID NO: 141151 - RNA, 60 nt, Human
gccuucuggguuugguuugguggcauuaaauggcaauuugugacugagacaccagagggc

SEQ ID NO: 141152 - RNA, 101 nt, Human
cauaggaaggauuuguuguggauucacaucugugauucaguguauacaggccuucuguugauaccggguucaagguguugagucccaguggucacucugug

SEQ ID NO: 141153 - RNA, 76 nt, Human
ucacuugagcccaggaguuggaggcugcagugagcuaugauugcaccacuguacuccagccugggugacagaguga

SEQ ID NO: 141154 - RNA, 84 nt, Human
ccuucccaucauucucuuaacaucugaccaaaucuugacuugcauuauguggcauaauaggauggcgaguccaugguggggagg

SEQ ID NO: 141155 - RNA, 89 nt, Human
ccuaucacagaccugccagauuccucugguaaacugcagguucccucugccucaguuguggccagggauucugaccaggagaugauggg

SEQ ID NO: 141156 - RNA, 82 nt, Human
cuacaagucaaggggcaugcagucuugaauggggguccguucaguuguuuuaaaggccaccaugccuucgugacauuuguag

SEQ ID NO: 141157 - RNA, 112 nt, Human
guuacuucagcaaguagaagauggauauuuuugaugcccagaguguugucuuccccguccaggguaucucauucugaucaaaccgaauuggccauccauacugagaaguggc

SEQ ID NO: 141158 - RNA, 82 nt, Human; identical to SEQ ID NO: 140508

SEQ ID NO: 141159 - RNA, 89 nt, Human
gagauugcuugagcccagguaguugagacugcagugaaccaugauugugccacugcacucagccugggugacaguuaagacccugucuc

SEQ ID NO: 141160 - RNA, 88 nt, Human
ggagaauugcuugaacgccggggucggagguugcagugagccaugaucgcgccacugcacuccagccugggcaacagagcgagacucu

SEQ ID NO: 141161 - RNA, 86 nt, Human
gagaauugcuugaacgccggggucggagguugcagugagccaugaucgcgccacugcacuccagccugggcaacagagcgagacuc

SEQ ID NO: 141162 - RNA, 82 nt, Human
gaggcagaacuuccagugauucauuugguuguucauuuuguugggacugagaacagccagaugacuggauccacacugccuc

SEQ ID NO: 141163 - RNA, 96 nt, Human
gccguagaagagagccagcaugguguggcagaaggcucuggauuaguccuggguucuaguucugggucuucuacaaaccagcuccaugaauuaggc

SEQ ID NO: 141164 - RNA, 101 nt, Human
gggguuagaggagaaaaugaugugacucaggaauuccacagcuguuggucagccuggcaguucugggcauaucuagucacaucggaggucccagugucccc

SEQ ID NO: 141165 - RNA, 99 nt, Human
gagaugagaggauugcuugaauccaggagguggaggcuguagugagcuaugauuguggcacagcaguccagccugggugacacaaggauacccugucuu

SEQ ID NO: 141166 - RNA, 96 nt, Human
cuggaggcagcaaagauuaucuuauuuauuuuauuuuguuuucugcuauauuuagaguggcaaaaaaauagagcagaggguuucugcugucuccag

SEQ ID NO: 141167 - RNA, 110 nt, Human
ggggguuuuggaacuggugaggccaggguuugaaucauggcucuaacaccgacuagcugggugagcagaaaauucaauuucugggccuaccaaauugaagaccagauccc

SEQ ID NO: 141168 - RNA, 100 nt, Human
gguuuuggaacuggugaggccaggguuugaaucauggcucuaacaccgacuagcugggugagcagaaaauucaauuucugggccuaccaaauugaagacc

SEQ ID NO: 141169 - RNA, 95 nt, Human
cccuacuauuuucuugggaaacauccagcacauacucaaggugggagggcaguaagcuugaugguggcuagauguuucugaagacaagaguaggg

SEQ ID NO: 141170 - RNA, 114 nt, Human
guuuaauccucguagcaauuuuggcaucgaggugguggaugaccucuuguuugugguggguggcuuuaaugguuuuaccaccaccuuuaauguugagugcuaugaugaaaagac

SEQ ID NO: 141171 - RNA, 87 nt, Human
gagaaucucuugaacccaggaggcagaggugguggugagucgagauagcaccauugcacuccagccugggcaacaagagcgaaacuc

SEQ ID NO: 141172 - RNA, 89 nt, Human
ggagaaucacuugaacccaggagacggaguuuguggugagccgagaucacaccauugcacuccagccugggcaacaacagugaaacucc

SEQ ID NO: 141173 - RNA, 77 nt, Human
ucacuugaacccaggagacggaguuuguggugagccgagaucacaccauugcacuccagccugggcaacaacaguga

SEQ ID NO: 141174 - RNA, 90 nt, Human
agcugcagcucuuucuucccuaugagcuuggacacaucaauccuaaacuaggagugugaaggaggaagggaggagcagggagcagcaguu

SEQ ID NO: 141175 - RNA, 89 nt, Human
ggagaaucgcuugaaccugggaggcggagguugcggugagccgagaucgcgccauugcacuccagccugggcaacaaaaccgaaacucc

SEQ ID NO: 141176 - RNA, 88 nt, Human
aguaucacuugaaccagggaggcagaggcugcaugcagugagccaagauugcaccacugcacucuaaccugggcaacagaaugauacu

SEQ ID NO: 141177 - RNA, 114 nt, Human
gcaucacugaugggcugucuucauuuccaguccauuuucgcugcgugguguuucauccauuccuagaugagauucucauugggaagaucaaaggcugcagcccagaaggagugc

SEQ ID NO: 141178 - RNA, 82 nt, Human; identical to SEQ ID NO: 140508

SEQ ID NO: 141179 - RNA, 86 nt, Human
gagaaucacuugaacccaggaggcagagguugcagugagcugagauuaugccauugcacuccagccugggugacagagugaaacuc

SEQ ID NO: 141180 - RNA, 83 nt, Human
ggaaugaaucuccggauuggccacuccuggauucccuagcucaggacacacauucaggugcaucaucaaucuggggucauucu

SEQ ID NO: 141181 - RNA, 109 nt, Human
aggguucagggcuucucuggagcagauauugucaaguucauggccuuagguagcauguaucuggucuuaacucugauuguagcaaaaguucugagaggagcugagcccu

SEQ ID NO: 141182 - RNA, 107 nt, Human
ggguucagggcuucucuggagcagauauugucaaguucauggccuuagguagcauguaucuggucuuaacucugauuguagcaaaaguucugagaggagcugagccc

SEQ ID NO: 141183 - RNA, 98 nt, Human
guggucauaagguccuuucuggcucuaauaaccugagcuucuguuaugaagcugggacccuuagagccucaggaugauccucuguuuguuugugaagc

SEQ ID NO: 141184 - RNA, 113 nt, Human
agucucacucuguugcccaggcugaagucaacggcaugaucucagcucacugcaaccuccaccuccuggguucaagcaauucucgugccucagccucccaaguagcuuggauu

SEQ ID NO: 141185 - RNA, 98 nt, Human
ggagacccaggacccgggagagagguagaggggagcagagacagccaccagcuucuaucuucugcucuaagcacauucuuucacgaguuuaaguuucc

SEQ ID NO: 141186 - RNA, 130 nt, Human
gaucccaaaaacucaucucagucuauguccuugcuauguauguacaaaaaugagaaauguaaauuguguuuaaaaaccuuaucucauuacauacuuucucaaaccacucuuugagugucauuuuuggguc

SEQ ID NO: 141187 - RNA, 82 nt, Human
uugggcccaggaggcuuugagaaagccuucucuguguacucuggagauagauggagaaguguuuucagauuccugggaacag

SEQ ID NO: 141188 - RNA, 80 nt, Human
ugggcccaggaggcuuugagaaagccuucucuguguacucuggagauagauggagaaguguuuucagauuccugggaaca

SEQ ID NO: 141189 - RNA, 86 nt, Human
cagaucuaauaaguagcuaagcuaggauucaaauccaggcagucugguugcugaguccacauucuuagcugcacaugauaggccug

SEQ ID NO: 141190 - RNA, 76 nt, Human
gcagaggcagaugggacucugugcccauugaagaacuugggaguguauucugggaacaggcacccaucuucucugc

SEQ ID NO: 141191 - RNA, 112 nt, Human
agugcugaugaugcaacaaguaauuaacuuucugugacgcaaagcugggaaggcagcuguggcuauuuuccaguuguucuagaaagcuagcgccuaggccuuugucagcgcu

SEQ ID NO: 141192 - RNA, 82 nt, Human; identical to SEQ ID NO: 140508

SEQ ID NO: 141193 - RNA, 103 nt, Human
ucuuuguauuuuuaguagagacgggguuucacuguguuagccaggauggucucgauccccugacaucgugauccgcuguccucggucucccaaagugcuggga

SEQ ID NO: 141194 - RNA, 102 nt, Human
ugaggcaggagaaucacuugaacccgggaggcagagguugcagugagccaagaucgcaccacugcacuccagccugggcaacaagggcgagacucugucuca

SEQ ID NO: 141195 - RNA, 73 nt, Human
cuggaggcucaggagucuuuuaucugcaauaggacaaugauucuccuagcagaucugugacuccuaugcucag

SEQ ID NO: 141196 - RNA, 80 nt, Human
aucugcauguuuuguugucucuguguuguacaguggaggagaaacaaugcauuuuggggacagcuaggacccaugcagau

SEQ ID NO: 141197 - RNA, 81 nt, Human
gacucuauguuaguguuugcccuguuuaucaggcagccuuuaggcauagcuauaguacagaccaaguucuggcauagaguc

SEQ ID NO: 141198 - RNA, 96 nt, Human
cagaucagcugcggcauuagauucucacaggagggcgagcccuauugugaacugcaugugcgugacccuuaggagaaucuaaugccugaugaucug

SEQ ID NO: 141199 - RNA, 86 nt, Human
cgcacaucuguuacuccacaucagagacuucauuuuguugauaaacccuaugaauguaaggaaugugggaaggcguucagagugcg

SEQ ID NO: 141200 - RNA, 130 nt, Human
uaaggaauguggaaaaaccuuuauuuguggcucagaccuuacucgacaucacagaauucacacuggugagaaacccuaugaauguaaggaaugugggaaagccuuuaguagugguucaaacuucacucga

SEQ ID NO: 141201 - RNA, 125 nt, Human
aggaauguggaaaaaccuuuauuuguggcucagaccuuacucgacaucacagaauucacacuggugagaaacccuaugaauguaaggaaugugggaaagccuuuaguagugguucaaacuucacu

SEQ ID NO: 141202 - RNA, 91 nt, Human
gagaaucgcuugaacccaggagguggaggcugcaguaagccgagauugugccacugcacuccagccugggcaacaagagcaaaacuaucuc

SEQ ID NO: 141203 - RNA, 73 nt, Human
gcuugaacccaggagguggaggcugcaguaagccgagauugugccacugcacuccagccugggcaacaagagc

SEQ ID NO: 141204 - RNA, 104 nt, Human
cucccuuccucuguccuccuugccuugggcuggaaugugggcucacauggauggugagguagcuucagccaugaagacaaggacaacacuccaggaugacggag

SEQ ID NO: 141205 - RNA, 111 nt, Human
guaguccaccucauaaaaucagaaaguauuacuggucucccacuuuuaggcuauuaacgcuuguagugagaguuuguagguuucuugucgugguugccaggggcugggggc

SEQ ID NO: 141206 - RNA, 101 nt, Human; identical to SEQ ID NO: 141139

SEQ ID NO: 141207 - RNA, 86 nt, Human
aggaucacuugagccugguaugucgaggcugcagugagcuaugaucgugccacugcacuccaaccaggcugaccgagccagacccu

SEQ ID NO: 141208 - RNA, 113 nt, Human
augccuaauuuagcacauaguuccuguccccaaaaucuaauaaacucagaaguaauaaauuuucuggguuuuuguggguuugcccucugagcuaggguaguuaaaaguugcau

SEQ ID NO: 141209 - RNA, 105 nt, Human
ucagugagaagcuuguacucucagugaucauugcuguaguuacgagauaagcuucucugaacaugcagagcagugguaacuaugaggaggcacagucucuccuga

SEQ ID NO: 141210 - RNA, 82 nt, Human; identical to SEQ ID NO: 140626

SEQ ID NO: 141211 - RNA, 102 nt, Human
ugaggcaggagaaucgcuugaacccaggagguggaggcuguggugagcugagauugcgccauugcacuccagccugggcaacaagagcgaaacuccaucuca

SEQ ID NO: 141212 - RNA, 89 nt, Human
ggagaaucgcuugaacccaggagguggaggcuguggugagcugagauugcgccauugcacuccagccugggcaacaagagcgaaacucc

SEQ ID NO: 141213 - RNA, 78 nt, Human
cucuuugaggucuguuguucagaaaaauuucuuggaaaauaugauuguucauggacaacggaccucaucacccaagag

SEQ ID NO: 141214 - RNA, 111 nt, Human
uaguaggaaagguaacaauaacagcaacacugauuauggcuagcaggcauccagccugagcccuagcuacacacccuuugauacaguguuagcuuugucuccagucugcug

SEQ ID NO: 141215 - RNA, 107 nt, Human
guaggaaagguaacaauaacagcaacacugauuauggcuagcaggcauccagccugagcccuagcuacacacccuuugauacaguguuagcuuugucuccagucugc

SEQ ID NO: 141216 - RNA, 77 nt, Human
uugcuugaacccaagagguggagguugcagugagcugagauugcgccacugcacuccagccugggcaacaagagcaa

SEQ ID NO: 141217 - RNA, 81 nt, Human
accagaggcucagagaauggcacagcuguccuguucuccacauuugaauaggccggacucaguuuucucugaguuuuuggu

SEQ ID NO: 141218 - RNA, 88 nt, Human
uguuggccaggauugucuugaucuccugaccuugugaucggcccaccucggccucccaaaguacugagauuacagacgugagccacca

SEQ ID NO: 141219 - RNA, 97 nt, Human
ggagaugguuuccaguucaccgucaacccaaaagcucucuucaggucauggcaaacagaccagggcuguggguguggcugugcuuggcacugacucc

SEQ ID NO: 141220 - RNA, 87 nt, Human
gaggaugguuugagcccaggaggcagaaguugcagugagcugaaaucaugccacugcacuccagccugggugauagagccaaaccuu

SEQ ID NO: 141221 - RNA, 76 nt, Human
ugguuugagcccaggaggcagaaguugcagugagcugaaaucaugccacugcacuccagccugggugauagagcca

SEQ ID NO: 141222 - RNA, 74 nt, Human
ggcauggaaugauauguacacuguagguucaauauguuuucaaaacauaccuagcaccuauggcugccugugcc

SEQ ID NO: 141223 - RNA, 84 nt, Human
gggaccguuagcugaaaugcuguugauuuuaguggcugugagcacacauaaggauacaggucauuucccuuauaauuagguccc

SEQ ID NO: 141224 - RNA, 97 nt, Human
gaggcauaagaaucgcuugaauucgggagguggagguugcagugagccaagaucacaccacugcacuccagccugggugacagcaagacucugucuc

SEQ ID NO: 141225 - RNA, 87 nt, Human
gguccuuccccacuccgaaccucaguuuucucaucugcaacauggggaaaacugcgccuguaaacuucguggaguuggugagggacu

SEQ ID NO: 141226 - RNA, 109 nt, Human
ucaaguccuguacugcucaauucagugaccacuagccauauguggcuacugagcacuugaaauguggcuaguuugaacugagaugugcucuaaguacacuggauuuuga

SEQ ID NO: 141227 - RNA, 100 nt, Human
guccuguacugcucaauucagugaccacuagccauauguggcuacugagcacuugaaauguggcuaguuugaacugagaugugcucuaaguacacuggau

SEQ ID NO: 141228 - RNA, 88 nt, Human
ggagaaucauuugagcccaggaagcagagguugcagugagccaagaucacgccacugcacuccagccugggcaacagagugagacucc

SEQ ID NO: 141229 - RNA, 77 nt, Human
guagaggguaugccugggaaaacaggagucacagaagcuucugugacuguauuuucccaaagagguuuauuauuuau

SEQ ID NO: 141230 - RNA, 76 nt, Human
gucuguugaguguauggaagugaaggauuggccaggcacaguggcucaccccuguaauuccagcacuuagcgagac

SEQ ID NO: 141231 - RNA, 101 nt, Human
guggcauagggugggccuuuaauccaaugugacugguguccauauaagagguggagaaauguagagacacagacacaugggagaaggccaugugauggcac

SEQ ID NO: 141232 - RNA, 103 nt, Human
uaguguucaagaccuacacuccauccuccuuuaauuugcccaguggccugacacuuggcagggcaagugcugucauauggaagaucuguuuacgugaacauua

SEQ ID NO: 141233 - RNA, 82 nt, Human; identical to SEQ ID NO: 140508

SEQ ID NO: 141234 - RNA, 84 nt, Human
ucauacuguaauguuaguuugcaugaaaagcucuguggugcaguggcaaacagggcuaaggauguuugcugaugucgcagugga

SEQ ID NO: 141235 - RNA, 107 nt, Human
gcuaccaggguaauagggccaaacgaggaaugggguuccauuaggauucaauuucagaacuuaaggcuauuccucguccuugucaguggcauaagugccaucuuagu

SEQ ID NO: 141236 - RNA, 100 nt, Human
aaggagggaaguuuaaauuuuguaauauggccuugguugcagaaguccugauacuaagguaauucuagcaaccuuaauauuuuacaguagauucccccuu

SEQ ID NO: 141237 - RNA, 95 nt, Human
agccugggucacuguaugguaccagugucagcuuccuguguuacacgagauggcacaguugggugaagcuggugaugaagguaugugaccccucu

SEQ ID NO: 141238 - RNA, 86 nt, Human
gggucacuguaugguaccagugucagcuuccuguguuacacgagauggcacaguugggugaagcuggugaugaagguaugugaccc

SEQ ID NO: 141239 - RNA, 107 nt, Human
gaacauccaggucuggggcaugaaccuggcauacaauguagauuucuguguucguuaggcaacagcuacauugucugcuggguuucaggcuaccuggaaacauguuc

SEQ ID NO: 141240 - RNA, 93 nt, Human
uccaggucuggggcaugaaccuggcauacaauguagauuucuguguucguuaggcaacagcuacauugucugcuggguuucaggcuaccugga

SEQ ID NO: 141241 - RNA, 111 nt, Human; identical to SEQ ID NO: 140513

SEQ ID NO: 141242 - RNA, 82 nt, Human; identical to SEQ ID NO: 140508

SEQ ID NO: 141243 - RNA, 93 nt, Human
aggcaaggucucacucggucauccagguuggaaugcaguggugugaucacaguucacuguaaacucaaacuccugggcucaaggaaucuuccu

SEQ ID NO: 141244 - RNA, 86 nt, Human
gguauugggagaaaaguguguuaucuagguaguccaggaaggucuuccuuucaugacaauacccauagacacuuagucccuugacu

SEQ ID NO: 141245 - RNA, 101 nt, Human
gaggccaggagucugagaucagcuugggcaacugauuuaugguuuggauuuguguccaugcccuuccucuucugccaugauuauaaguuuccugaggccuc

SEQ ID NO: 141246 - RNA, 101 nt, Human
ccuugggggcuuaaugauucagcguggaaugaguuuuguuguuaggguggacagaaaaacccuauggcaaagucacugauuucccugagugugcccuuugg

SEQ ID NO: 141247 - RNA, 100 nt, Human
ggugggugaugccaucuauagaaggguuuuaggucauuguguuggugucuuuccgucuuucccacuugagacccucuuguaaauauggacuugacccacc

SEQ ID NO: 141248 - RNA, 112 nt, Human
aggcccuggguggcgugagggggaaggugugugugugggguggcagggaggagaaggaaucugcucugugcuuauucuuguccccguuucuuuugcagccugcccacggcuu

SEQ ID NO: 141249 - RNA, 100 nt, Human
uggguggcgugagggggaaggugugugugugggguggcagggaggagaaggaaucugcucugugcuuauucuuguccccguuucuuuugcagccugccca

SEQ ID NO: 141250 - RNA, 80 nt, Human
ugguggaaggaaaaccugucauuccaaggacagucccaugacagggaagcugacacuucaguggcagguuaaucccccca

SEQ ID NO: 141251 - RNA, 96 nt, Human
ucugccaguuuuuaugccacacuggcucugugcuucuaguaucugcauuuaaugcuuagauucuaccagagcuaguuugggcacaaaguuuccaga

SEQ ID NO: 141252 - RNA, 95 nt, Human
auguucugaaguacugaggguuagggcuucaacuuacgaauuuggugaguucacaguucagccuguaacacauuucuucaggauuuccagagcgu

SEQ ID NO: 141253 - RNA, 130 nt, Human
uucauuaggaaaggguuuugaggucaggacauggguaucugguguacaugggaguuugguggccucuauuguaggaggcuuuggaaauguguauuguugggagguccugagggaggaaguuugggaugaa

SEQ ID NO: 141254 - RNA, 102 nt, Human
ugaggcaggagaaucgcuugaaccugggaggcagagguuguggugagccgagaugaggucauugcacuccagccugggcaacaagugugaaacuccgucuca

SEQ ID NO: 141255 - RNA, 100 nt, Human
gaggcaggagaaucgcuugaaccugggaggcagagguuguggugagccgagaugaggucauugcacuccagccugggcaacaagugugaaacuccgucuc

SEQ ID NO: 141256 - RNA, 98 nt, Human
cacucccugagugaagguguguguguuaggaaaugugcuuacugggugaacacaacagagguguuccccaccucaugauacccacagucuagggagug

SEQ ID NO: 141257 - RNA, 82 nt, Human; identical to SEQ ID NO: 140508

SEQ ID NO: 141258 - RNA, 99 nt, Human
cuaggcauuguaacucucaagucuuaaauacucaucagcuggucaguccauugggucuggcaaauuauguguauuuaacccuugagaacucaugcuugg

SEQ ID NO: 141259 - RNA, 93 nt, Human
ggcauuguaacucucaagucuuaaauacucaucagcuggucaguccauugggucuggcaaauuauguguauuuaacccuugagaacucaugcu

SEQ ID NO: 141260 - RNA, 105 nt, Human
ggcuggggaaguuacuuaccuacuccgugucucaguuuuacuuaucucuaaaagggguagaguaacagcacucacuggaguggagugugguuaugccucccagcc

SEQ ID NO: 141261 - RNA, 80 nt, Human
ccagaaauuucauccccacuggucaguaaggaagcucgucugcucccagaguuucaguggagaccacgugggaauucugg

SEQ ID NO: 141262 - RNA, 82 nt, Human; identical to SEQ ID NO: 140508

SEQ ID NO: 141263 - RNA, 81 nt, Human
cugccuagcuuagugagggaauccauucuggcuucagaccagucuggguuugaaaccuacacaucccacuaacuuaggcag

SEQ ID NO: 141264 - RNA, 102 nt, Human
aguuaugugacccuuaaagaaacaaaucagaaguuaugugacccucuaacacacugagagagaggcacagugaagcuguguuugguuuaagguugccuagcu

SEQ ID NO: 141265 - RNA, 92 nt, Human
aaggauguguucacugaagccuaccauacauaugugacccuuauuaguuacacauaaggcauuuuuaugguggucuuugcccccuuaucuuu

SEQ ID NO: 141266 - RNA, 94 nt, Human
agguucacacauuggugccuuugcugggacaaaaaagagacuuuccugaggguugucuuguuccaguuucucagccacucaccaugugauaccu

SEQ ID NO: 141267 - RNA, 92 nt, Human
gguucacacauuggugccuuugcugggacaaaaaagagacuuuccugaggguugucuuguuccaguuucucagccacucaccaugugauacc

SEQ ID NO: 141268 - RNA, 101 nt, Human
gcgcugucuuccugggcucagcauccugggacacaggacauuguaguggagcaucccaaccugaaacuuugucucaguguagagacccagaaagauggggu

SEQ ID NO: 141269 - RNA, 85 nt, Human
agcucaaaguuacauggggucugacccuguaggucucuaaccagaguguagagaucucaggacagacuuuuugcagccacaugcu

SEQ ID NO: 141270 - RNA, 69 nt, Human
gcagcugcagaaaacacagccgaguugcuagcuaaggggaaacagacgccgcugugggaaagcacuugu

SEQ ID NO: 141271 - RNA, 101 nt, Human
ugaggcaggaagaucacuugagcccaggagguggaggcugcagugacccauauucaugccacugcacuccagccugggcaacagagugagacccucucuca

SEQ ID NO: 141272 - RNA, 91 nt, Human
cugcaaugcuguuuacuuauaggaugaaacuguaucagacuuuguaguggcugugcauguugauauccuggccaguaggcagugcgugcag

SEQ ID NO: 141273 - RNA, 87 nt, Human
gcaaugcuguuuacuuauaggaugaaacuguaucagacuuuguaguggcugugcauguugauauccuggccaguaggcagugcgugc

SEQ ID NO: 141274 - RNA, 72 nt, Human
cccuggcugaggugggaucccgaggccucuccaguccccugagggugcaccacuggcccaucucacccaggg

SEQ ID NO: 141275 - RNA, 102 nt, Human
aaaagccauguuacagauggcucuccuuggauggcuauuccagucgguuuccggggcugacuggcccacuccauuuaggguguguagcugugaguguauuuu

SEQ ID NO: 141276 - RNA, 103 nt, Human
ugaggcaaggucagaaaaggucaggcaauuuuugccuuguucauugcaacacucccuuuggagcucugaguuuaagcuaagaagucugacuaccuugcugcca

SEQ ID NO: 141277 - RNA, 101 nt, Human; identical to SEQ ID NO: 141271

SEQ ID NO: 141278 - RNA, 95 nt, Human
ccgucacagcacuugcccucaauguucaucacugaagacaagcaugugauuuucucaucacauccucccacuucaaguggggcagggcagugagg

SEQ ID NO: 141279 - RNA, 80 nt, Human
agggugugcacugggcaagggcagggcggcaggugucaggccggcuuggacaaugaaacccugaccuugcugcauuccuu

SEQ ID NO: 141280 - RNA, 88 nt, Human
ggagaaucgcuugaacccgggaggcagagguugcagugagccgagaucgcacuacugcacuccagccugggcaacagagugagacucc

SEQ ID NO: 141281 - RNA, 92 nt, Human
gagaaucgcuugaacccaggagacugagguugcagugagcugagaucaugcaacugcacuccagccugggcaacacagcaagacuucaucuc

SEQ ID NO: 141282 - RNA, 72 nt, Human
gcuugaacccaggagacugagguugcagugagcugagaucaugcaacugcacuccagccugggcaacacagc

SEQ ID NO: 141283 - RNA, 76 nt, Human
uucucugucuuccauuccccuccuacgcccccagacugugagggguguaaggaagauggaagauguugcgggaggg

SEQ ID NO: 141284 - RNA, 74 nt, Human
ucucugucuuccauuccccuccuacgcccccagacugugagggguguaaggaagauggaagauguugcgggagg

SEQ ID NO: 141285 - RNA, 97 nt, Human
ucucaacuucuuuaugucucuguacaguggguguagggaccagccacacagggucgguggguuuuucuccccgugugcagagaugagagauuguaga

SEQ ID NO: 141286 - RNA, 81 nt, Human
cccucagcacagguuuuggcucuuagaauggguuuuuuaaaaaaaggaucuuucuuaauuccaggacuccugaguuggggg

SEQ ID NO: 141287 - RNA, 90 nt, Human
ucaugcguucuucauuucuguaccucccaacucaaugcuuagcacccagcaggggcucaagacuguguguggaaugaaggauucguguga

SEQ ID NO: 141288 - RNA, 74 nt, Human
auuuccugcugccagcuuaauacucaccagggcagauucacaccaaguugggguuucaguggcagucaggaagu

SEQ ID NO: 141289 - RNA, 131 nt, Human
gagauggcaauuuaaacugcuuugaugaccagguuucauuagguaagaaggcccgauuaagcaacgguggcccaaauaaccucagugguucagacacuguuuuucaaagccagcagaagucuugccaaauu

SEQ ID NO: 141290 - RNA, 92 nt, Human
gcuuugaugaccagguuucauuagguaagaaggcccgauuaagcaacgguggcccaaauaaccucagugguucagacacuguuuuucaaagc

SEQ ID NO: 141291 - RNA, 101 nt, Human; identical to SEQ ID NO: 141271

SEQ ID NO: 141292 - RNA, 79 nt, Human
ucuuuuucucagugucucuguuguggcagucaugaaugagacucugucagaucuccauggcagggaccugauugacaga

SEQ ID NO: 141293 - RNA, 97 nt, Human; identical to SEQ ID NO: 140635

SEQ ID NO: 141294 - RNA, 85 nt, Human
gcagguaugauggccuuuucucuuauccugguuccugcagagcugacugccaugcuugggagagggaaaagacuuauuugccugu

SEQ ID NO: 141295 - RNA, 99 nt, Human
gcauuuacaauggggaagggacaguguucucaccaaaggauauugggaaagcuggauauccaagggcaagaagauuggaaccuuuaccuaacaccaugu

SEQ ID NO: 141296 - RNA, 88 nt, Human
ggagaauugcuugaaccugggaggcagugguugcagugagccgagauugugccacugcacuccacccucagcaacagagcaaaacucc

SEQ ID NO: 141297 - RNA, 103 nt, Human
ugaggcaggagaaucgcuugaaccccgggagguggagguugcagugagccgagaucgcgccauugcacuccagccugggcaacaagagugaaacacugucuca

SEQ ID NO: 141298 - RNA, 93 nt, Human
guggugcauaccuguaaucucagauacuugggagguugaggugguaggauugcuugagcucaggaguuugaggcugcaguaagcuaugaucac

SEQ ID NO: 141299 - RNA, 71 nt, Human
cugggaucuggagaggaggggcuucacaaggucaugccgaucuaagggacgcccccuucucucuacaccag

SEQ ID NO: 141300 - RNA, 94 nt, Human
caggcugguucgucguuucugccucuccauucuugucuuuuuaauucuuuguguuauuugagauggaguuugagagggaauaugaacaagccug

SEQ ID NO: 141301 - RNA, 92 nt, Human
aggcugguucgucguuucugccucuccauucuugucuuuuuaauucuuuguguuauuugagauggaguuugagagggaauaugaacaagccu

SEQ ID NO: 141302 - RNA, 88 nt, Human
gggcauuuugccucugguagggauggccauggugccagcccuccugggccucauuggguaucaccuauacagaaaggccaauagaccc

SEQ ID NO: 141303 - RNA, 82 nt, Human; identical to SEQ ID NO: 140508

SEQ ID NO: 141304 - RNA, 110 nt, Human
uaggggcaguggcagagaaugaauguauguguggguuucucagccuugagguauaaggucuaaaggcucuggggauucacugcauacaccacuuccaguucaagcgccua

SEQ ID NO: 141305 - RNA, 93 nt, Human
gggcaguggcagagaaugaauguauguguggguuucucagccuugagguauaaggucuaaaggcucuggggauucacugcauacaccacuucc

SEQ ID NO: 141306 - RNA, 104 nt, Human
ugagucacugggccugggccgaaaucaucaguggaacuuugauuaggaucauaaaaugggaaguuggucaaaaucacagauggcuggcggggcacgguggcuca

SEQ ID NO: 141307 - RNA, 102 nt, Human
gagucacugggccugggccgaaaucaucaguggaacuuugauuaggaucauaaaaugggaaguuggucaaaaucacagauggcuggcggggcacgguggcuc

SEQ ID NO: 141308 - RNA, 101 nt, Human; identical to SEQ ID NO: 141271

SEQ ID NO: 141309 - RNA, 100 nt, Human
cacgagcaguuugugucacagauggccggaagagacucuuuugccugguuacaggcauguuuuucugccauccuguugaauuuucccaucaacuccuuug

SEQ ID NO: 141310 - RNA, 86 nt, Human
gagaauugcuuaaacccgggagguggagguugcagugagccaagaucacgccacugcacuccagccugggcaacagagugagacuc

SEQ ID NO: 141311 - RNA, 113 nt, Human
gcaccagaaaguccaggaagagcugauuaaaguguuagcuggcugacacauuaugguggugugguagaaagugucucauuuuaauaagucacagugcugccuaaucugugugc

SEQ ID NO: 141312 - RNA, 75 nt, Human
gggagggacuucuuggcuucugagggcaaagcucuacgugagugguccuuggcucuuugaccgagaugcucaccc

SEQ ID NO: 141313 - RNA, 102 nt, Human
ucugucucucucucaucuuccuuuugccacccaggcuggaauguaguggugugaucacagcucacuacagccuggauucagcacacaggaaucagagucaga

SEQ ID NO: 141314 - RNA, 112 nt, Human
ucaggcauaaauauucugaugguuaauuuuagacaucuacuugacuggauuaagagacacacauagcuggucaaacaugauuucugacaugaaucaggcauaaauauucuga

SEQ ID NO: 141315 - RNA, 99 nt, Human
aauauucugaugguuaauuuuagacaucuacuugacuggauuaagagacacacauagcuggucaaacaugauuucugacaugaaucaggcauaaauauu

SEQ ID NO: 141316 - RNA, 82 nt, Human; identical to SEQ ID NO: 140508

SEQ ID NO: 141317 - RNA, 86 nt, Human
cgggugaggaaguguuauugucagggucucccuuucagaaggccuuggggccaaggggaggagcuggaauugccuuccaccgcgug

SEQ ID NO: 141318 - RNA, 79 nt, Human
ggugaggaaguguuauugucagggucucccuuucagaaggccuuggggccaaggggaggagcuggaauugccuuccacc

SEQ ID NO: 141319 - RNA, 84 nt, Human
agaaucacuugaaccugggagguggagguugcagugagccgaaauugugccacugcacuccagucuaggugacagagcgagacu

SEQ ID NO: 141320 - RNA, 101 nt, Human
ggcgugagggaaagcaugaaaaauccaggauaaaaucaucaucagggaaacuccuaugaugcuggaacuggacaacaguguuuuagaucccuagucaugcc

SEQ ID NO: 141321 - RNA, 114 nt, Human
aauggggugaugguaccuaauaauacaguagagcacuuaacacaguagguggcacaugguaagccacauacugaguauguauuugcuaugauuguuauugcuauuauuacuauu

SEQ ID NO: 141322 - RNA, 90 nt, Human
gucagcaccgagguagcagagaauuaacauucuugucagcagagaaugaagcaggaauauaauuaaaacuuugcccuuggaauagcugau

SEQ ID NO: 141323 - RNA, 106 nt, Human
ggggacauaaccguagguggccgugccaacaggaaaccccaggaagucuggcuucagagccauucccuuuagcucugauggcacacugucuuguaguucagucuuc

SEQ ID NO: 141324 - RNA, 88 nt, Human
ggagaaucgcuugaacccaggagguggagguuguggugagccaagaucgugacauugcacuccagccugggcaacagagcgagauucc

SEQ ID NO: 141325 - RNA, 77 nt, Human
ucacuugaacccgggaggcggagguugcagugagcugaggucgugccacugcacuccagccugggcaacaagaguga

SEQ ID NO: 141326 - RNA, 88 nt, Human
ggagaaucgcuugaacccaggaggcggagguugcagugagcugagauugcacuauugcacuccagucugggugacagagugagacucc

SEQ ID NO: 141327 - RNA, 88 nt, Human
uggcucacaccuguaauccccgcuacucaggagguuuaggcaggagaaucacuugaacccgagaggcagagguuacaguagugaguca

SEQ ID NO: 141328 - RNA, 76 nt, Human
ggugguuauggugaugugcaccuguagucucaucugcuuuggaguugaggcugcagugaacuaugaucgugccacu

SEQ ID NO: 141329 - RNA, 88 nt, Human
uugggcuacuuauaggagugaaaauaaacucugugaugugccagcaccagcacaggcucuuguaguuuccucccaacuuugggcucag

SEQ ID NO: 141330 - RNA, 92 nt, Human
ggcuuccccagucauauauucucagauucaaaggaacaaaguggccccagucagccuuucccagaaaccugugagugugguggcuggaagcc

SEQ ID NO: 141331 - RNA, 108 nt, Human
gcucuucccauaccaugcauuccuagccccacagaaauccacuagucugggcuuucucugcgauuggcugaggcagcaacuggugaggcaccugggcugugcaggagc

SEQ ID NO: 141332 - RNA, 106 nt, Human
caaaucaguggcauauuagauucucauaggaaugugaaccguguugugaccaugcgagggaucuagguugcaugcucuucaugagaaucuaauaucugaugaucug

SEQ ID NO: 141333 - RNA, 97 nt, Human
aucaguggcauauuagauucucauaggaaugugaaccguguugugaccaugcgagggaucuagguugcaugcucuucaugagaaucuaauaucugau

SEQ ID NO: 141334 - RNA, 102 nt, Human
uaggagggaggauugcuugaguccaggaguugaaggcuacagugagcuuugaucacaucacugcacucuagccugagcaacaaagcaagaccucaucucuua

SEQ ID NO: 141335 - RNA, 78 nt, Human; identical to SEQ ID NO: 140828

SEQ ID NO: 141336 - RNA, 98 nt, Human
gaggcaggagaauaacuugaacccaggagacggagguuguugugagccgagaucgcgccauugcacuccagccugggcaacgagcgaaacuccgucuc

SEQ ID NO: 141337 - RNA, 66 nt, Human
auagcaccaauugagaaccacugcugccuauuauaaggcaaucaguuuuuccuagggaaguguuau

SEQ ID NO: 141338 - RNA, 102 nt, Human
gucucucagagguagagugugucuauggaagggguugucaugguaacagcuucuguuggcuucuagcccuaccuuuucuggacacauucaugcuagagggau

SEQ ID NO: 141339 - RNA, 84 nt, Human
cagauaaccagacacaccccugggcugggcacacaguuccuuauuuggguuuugugguuuucccaggugguagcugggacucug

SEQ ID NO: 141340 - RNA, 89 nt, Human
uggauguggagggugacugagaggauagaaugaguacccaugaauagccaugauuccuacccugucccagucaucucuuuccuuaucca

SEQ ID NO: 141341 - RNA, 74 nt, Human
ugucuccugggaugcugugggguugacccuggauagcauucacggucauuagcucaugguguucuugggagaca

SEQ ID NO: 141342 - RNA, 99 nt, Human
gaggcaagagaauugcuugagcccgggaggcgaagguugcagugagcugagauggugccacugcacuccagccugggcaacagagcaagacugugucuc

SEQ ID NO: 141343 - RNA, 97 nt, Human
gaggcaggagacucgcuugaacccaggaggcggagguugcagugaggugagauggcgcuacugcacuccagccugggcaacagauugagacugucuc

SEQ ID NO: 141344 - RNA, 81 nt, Human
gagguaaagcuggggcugggguuccuuaugcaaagagagcugucucuuuaguaggaacucuggauuggcucauuuugcuuu

SEQ ID NO: 141345 - RNA, 93 nt, Human
augcucaaguauacugaugucaccaggcagaauucagauaauggugaccagagauccugucugagcaaccuggugacauuagauaccagacau

SEQ ID NO: 141346 - RNA, 102 nt, Human
ccuaagccuagcgcccucaccuguucaacagcaauaaucaggccugucuugccuaccucacuagauuauugcaagcagugaagggacgugaacaggcucugg

SEQ ID NO: 141347 - RNA, 94 nt, Human
agccuagcgcccucaccuguucaacagcaauaaucaggccugucuugccuaccucacuagauuauugcaagcagugaagggacgugaacaggcu

SEQ ID NO: 141348 - RNA, 95 nt, Human
ugagaagucaguccugauggcagcugugcagagugggggugaggaggccaacuuacugcuuccugaacugggcagugccuucuaugacauggcca

SEQ ID NO: 141349 - RNA, 87 nt, Human
gucaguccugauggcagcugugcagagugggggugaggaggccaacuuacugcuuccugaacugggcagugccuucuaugacauggc

SEQ ID NO: 141350 - RNA, 92 nt, Human
acauauggcagaauggaagugauuucuccuaaugaaaaugaagugcucuuuugaguauuucuuguuuuauugagauuccuaucugcccuugu

SEQ ID NO: 141351 - RNA, 81 nt, Human
ggcagaauggaagugauuucuccuaaugaaaaugaagugcucuuuugaguauuucuuguuuuauugagauuccuaucugcc

SEQ ID NO: 141352 - RNA, 92 nt, Human
agcaggauuaggaagagaagcauugugagaaacagguuuuggguuuugcugaaauuugcuugucagcauugcaucacuuuuccuuaacuguu

SEQ ID NO: 141353 - RNA, 70 nt, Human
gcgggcuaggcagucucaguuguuggguuuucuuagugaaauaagcagcaacaaacgacaacaaaaccgc

SEQ ID NO: 141354 - RNA, 89 nt, Human
ggagaaucgcuugaacccuggaggcagagguugcggugagccaagaucgugccauugcacuccagccugggcaacaagagugaaacucc

SEQ ID NO: 141355 - RNA, 126 nt, Human
augauggaggaaggaggggaauguugcaaaaacagagcaagaaaaagggugaaaaaaauaauauuaucauucacuuagucaucaagccugaaaaugaagucauuuugaccaaguuuuccccauuau

SEQ ID NO: 141356 - RNA, 83 nt, Human
gcuaacagaggcaaaucuugaguaucuccaggugcauaacagacuuguuuaugagagauugcucaugauucuagccucaaagc

SEQ ID NO: 141357 - RNA, 82 nt, Human; identical to SEQ ID NO: 140508

SEQ ID NO: 141358 - RNA, 91 nt, Human
ggagaguuauuuuauguuuguguuucugggaauuuccgauacuucccaguguaucagaguguuccccucacacaugcuagcaggcaucucc

SEQ ID NO: 141359 - RNA, 102 nt, Human
ugagacggaguuucgcucuugucccccaggcuuuagugcaauggcgcgaucucggcucaccgcagccuccgccaccuggguucaaacgauucuccugccuca

SEQ ID NO: 141360 - RNA, 78 nt, Human
ucacugauuuuguagagcugcugggagaacuggaagaauaacauccauugucguacagcuccaaacaacuucagauga

SEQ ID NO: 141361 - RNA, 71 nt, Human
cugauuuuguagagcugcugggagaacuggaagaauaacauccauugucguacagcuccaaacaacuucag

SEQ ID NO: 141362 - RNA, 102 nt, Human
ugaggcaggagaaucacuugaacccgggagguggagcuugcggugagccgagaucgcgccauugcacuccagccugggcaacaagagugaaacuccaucuca

SEQ ID NO: 141363 - RNA, 89 nt, Human
ggagaaucacuugaacccgggagguggagcuugcggugagccgagaucgcgccauugcacuccagccugggcaacaagagugaaacucc

SEQ ID NO: 141364 - RNA, 82 nt, Human; identical to SEQ ID NO: 140508

SEQ ID NO: 141365 - RNA, 56 nt, Human
ggaggugggaugugugugcuacuggcaucuaguggcugcuaaacauccuacacugc

SEQ ID NO: 141366 - RNA, 111 nt, Human
cgaggcagugagauuugggauuccggggucuggagaucgugcuuuuuguggacugcguuugcaguuccuagggugcugcugauucacaggccuucucugucuuuaagugug

SEQ ID NO: 141367 - RNA, 98 nt, Human
guguuagagaccaguuaaaguuaagacacuuucuaaauagaagucuuguauauggggcuuuugagaaaguguuuucccgugaugcuggggggaaacac

SEQ ID NO: 141368 - RNA, 100 nt, Human
gcguggcuuaaaauugcuuuuacugucauacagcuggcgaugaggagguaccuauuguguugaguaacggugauaauuuuauacgcuauucugagccagc

SEQ ID NO: 141369 - RNA, 82 nt, Human
accucaucucuacaaaaaauacgaaaauuagcugggugugguggcauguaccuguagucccagcuauuugagagacugaggu

SEQ ID NO: 141370 - RNA, 80 nt, Human
ccucaucucuacaaaaaauacgaaaauuagcugggugugguggcauguaccuguagucccagcuauuugagagacugagg

SEQ ID NO: 141371 - RNA, 85 nt, Human
acagugcagucacccauaaaguagaaagcacuacuaacagcacuggaggguguaguguuuccuacuuuauggaugaguguacugu

SEQ ID NO: 141372 - RNA, 111 nt, Human
gaauagcgaguugcccaagcucacaaaguaugugauggagcuagagauucaaacccaggccucucuggcuccuucuuuggggugggcuugcucugggaaaauaugcuauuu

SEQ ID NO: 141373 - RNA, 106 nt, Human
ccuuugcuuuggccuuuaacaacucaguguuuuggucuaaucuucaagaggaauuugagguucacuugaauaaguuagacuaguuugagguggguguagcuagagg

SEQ ID NO: 141374 - RNA, 109 nt, Human
gcuuuggccuuuaacaacucaguguuuuggucuaaucuucaagaggaauuugagguucacuugaauaaguuagacuaguuugagguggguguagcuagaggauugaagu

SEQ ID NO: 141375 - RNA, 82 nt, Human; identical to SEQ ID NO: 140508

SEQ ID NO: 141376 - RNA, 83 nt, Human
ugggugccuguaaucccagcuacuugggagguugaggcaggagaaucacuugaacccaggagguggagguugcagugagccca

SEQ ID NO: 141377 - RNA, 101 nt, Human
ugagaugggaggacugcuugagcccaggagguugagguugcagugaaccaugaucaugucacugcacuccagccuggguaacagagugagaccuuguuuca

SEQ ID NO: 141378 - RNA, 83 nt, Human
ggacugcuugagcccaggagguugagguugcagugaaccaugaucaugucacugcacuccagccuggguaacagagugagacc

SEQ ID NO: 141379 - RNA, 101 nt, Human
gaggugggagggucacuugagcccagaauuucaaggcugcagugagcuaugauuaagccacugcacuccagccugggcaacagagugagaccuccaacuuu

SEQ ID NO: 141380 - RNA, 82 nt, Human; identical to SEQ ID NO: 140508

SEQ ID NO: 141381 - RNA, 88 nt, Human
gggagacuugcuugaacccaggaggcggagggugcagugagucgacaucaugccacugcacuccagccugggcaacagagcaagaccc

SEQ ID NO: 141382 - RNA, 78 nt, Human
cuugcuugaacccaggaggcggagggugcagugagucgacaucaugccacugcacuccagccugggcaacagagcaag

SEQ ID NO: 141383 - RNA, 106 nt, Human
uuccauuuucucauugccugaagaucucugcugaugcuccuggagaaugacuuugggggcuuuagaaagaauauugccaguccgucucggcaaggagaugauggga

SEQ ID NO: 141384 - RNA, 110 nt, Human
gucacuccaacucuuauagaccagaauucauuuauaaagcagaaagauaagccaauaugagagagguuaugaagcugauguuugauuucuggucuccugcguggagcgau

SEQ ID NO: 141385 - RNA, 81 nt, Human
uuggggugcugaggugggaggaucacuugagccagaaaguuggaggcugcagugagcucugaucuugccaccacacuccag

SEQ ID NO: 141386 - RNA, 79 nt, Human
uggggugcugaggugggaggaucacuugagccagaaaguuggaggcugcagugagcucugaucuugccaccacacucca

SEQ ID NO: 141387 - RNA, 90 nt, Human
ggagaaucgcuugaacccgggaggcggaggugguggugagccgagauugugccacugcacuccagccugggcaacaagagcaaaaacucc

SEQ ID NO: 141388 - RNA, 111 nt, Human
cucucuuuggcuacagacuuaccucaggcuggcuggagaguaaaucaggucuaaaagagucuccuucauaacaggcugaggauacucccagcaaucugaagccggagagag

SEQ ID NO: 141389 - RNA, 96 nt, Human
gaagaacugggugaucuugugaaaucuguggacccuacauuggcacuuaguguguaccuaagggcuaacgucccaaauaaagucauucagugcuuu

SEQ ID NO: 141390 - RNA, 102 nt, Human
ugaggccggagaaucgcuugaacccuagaggcagguugcagugagcccagauugcaucaccacugcacuccagccugggcaacagagggagacuccaucuca

SEQ ID NO: 141391 - RNA, 84 nt, Human
gaucuuuuccuuucgauaagugguuuaaagugagcagagaauugaacucugcuucuugcaccgcauguugaguggcugcugauc

SEQ ID NO: 141392 - RNA, 111 nt, Human
ucugaaagcauaauaaauuagcaaaacaguauucgcugcggggucuugcagauuuuauugcuugauacaacagcaggacccuugccugugccuguaguuauuauguucggg

SEQ ID NO: 141393 - RNA, 106 nt, Human
aucaucaggcauuagauucucauaaggagcacacaaccuagauugcuagcaggcacaguucacaauaggguucguucuccugugagaauggcaugccgcugcugau

SEQ ID NO: 141394 - RNA, 90 nt, Human
ggcauuagauucucauaaggagcacacaaccuagauugcuagcaggcacaguucacaauaggguucguucuccugugagaauggcaugcc

SEQ ID NO: 141395 - RNA, 130 nt, Human
gucuaggucugauaauuuucauucauuucuuucauggacauggugacucuuuucuugccauccuuaaggagaaaagccauggacacuacaaaaucuuugagguuugaagugggaacuaggagauucaggc

SEQ ID NO: 141396 - RNA, 82 nt, Human
ugcaaggcuucaccuucaacuagggaagaauaaagugcuaaagcccacuuugguuucuccugaguuuguguauagccuugua

SEQ ID NO: 141397 - RNA, 82 nt, Human; identical to SEQ ID NO: 140508

SEQ ID NO: 141398 - RNA, 91 nt, Human
ugggguacugagagucaaagacuuggcugucagcccugagucugccucaaccuccaagggucauagccacggcuucacccucugugccuca

SEQ ID NO: 141399 - RNA, 72 nt, Human
gggacaagagaaccucaugcugggcaaggggcucuguucucuucuuguaccaacaaaucuuucucuuguuuc

SEQ ID NO: 141400 - RNA, 78 nt, Human
uccuuugcuaguggugggucacccucuguugcuagggaaacgguucccuagcaacagaacgccacuauuugcuaggga

SEQ ID NO: 141401 - RNA, 109 nt, Human
cuguaauuccagcacuuugggaugccgaguugagaggaucacuugaagccgggaauuugaggcugcagugagcuaugaucaugccgguguacuucagucugggcaacag

SEQ ID NO: 141402 - RNA, 96 nt, Human
aguucccacgugcauggagcuguaguuuuucccacauuccucuuaggagcugugccuaagaugcugcgcuagcaaccucuguauugugaaggaacu

SEQ ID NO: 141403 - RNA, 76 nt, Human
uccuucaguggaugauguuuucuguggucuuguucaggaauuuacaaacuagaggaagccuuaucucaccaaggga

SEQ ID NO: 141404 - RNA, 97 nt, Human
cagugugaagguuuuuauacuucugccagaggacaacguaauaugaaacaccgaguuuuauuugucucuacagagaguaguagugucuuucaggcug

SEQ ID NO: 141405 - RNA, 77 nt, Human
guaccagcaucuggugaggacugcaaucgacuuccaagaugacgccuugaaugccauacccaccagaaggcugguac

SEQ ID NO: 141406 - RNA, 82 nt, Human; identical to SEQ ID NO: 140508

SEQ ID NO: 141407 - RNA, 107 nt, Human
cucccccgagaaugucagccccuugaagcugcggucugucuaugcuggucguacccucagagccuaagaugacacagagcucaggaaaugaacacccucggaggggg

SEQ ID NO: 141408 - RNA, 95 nt, Human
guaagaaagaugucuguagaauggagacuuugucaagcucuuugcccuugauggggaagagagcugugauaaucccugcagaacacauuggcuac

SEQ ID NO: 141409 - RNA, 90 nt, Human
agaaagaugucuguagaauggagacuuugucaagcucuuugcccuugauggggaagagagcugugauaaucccugcagaacacauuggcu

SEQ ID NO: 141410 - RNA, 122 nt, Human
uuccaguucugcuauaaucaagaccuuauuguccauaacucaauuuagagaagguuuagcugucuaccaacucuugugcagaguuucugugaaguuuuguuuuggguugcaagaaucuggaa

SEQ ID NO: 141411 - RNA, 122 nt, Human; identical to SEQ ID NO: 141410

SEQ ID NO: 141412 - RNA, 86 nt, Human
ugaguaagaggagguggggaacuuugagagacaucguaauggcuguccaccacagucuuccuccguccccaccucccagugauuca

SEQ ID NO: 141413 - RNA, 96 nt, Human
aagacggcaaauauucuggggugaaggagguauaauggggaaacacauuuauuuuccccuuuuaaacuucccugcugccccagucuuugccuucuu

SEQ ID NO: 141414 - RNA, 82 nt, Human
gaaauccugggguugcaagacugccagccugugugaucaauccugcgguuaggaagguggaguuuugcuuucccaucuuuuc

SEQ ID NO: 141415 - RNA, 82 nt, Human; identical to SEQ ID NO: 140508

SEQ ID NO: 141416 - RNA, 83 nt, Human
uuggcuucccuggucuccauuucuucagcagccugacuucuuuaccaagcugaugugaaaagaaugugaccugggaaugcgga

SEQ ID NO: 141417 - RNA, 109 nt, Human
auaagcugcucuaauugccaagaauucacaugugguuguaugcagcuuuacugggagacugaaguguaucugcaugugauucugcugugauggacacuuguaaguuugu

SEQ ID NO: 141418 - RNA, 106 nt, Human
uacauguguuacacucaguguguaaauaacugugaagaggcaauugucagauagcaaauugggcaccugcuguguacgguauauugcacuggggcugacgggugug

SEQ ID NO: 141419 - RNA, 93 nt, Human
uuagccucccagauguccuugugcuaguuuuagcuguuuucagguguugauaaaagcuccaggagcuggcaggaggagagcagaggaagcuag

SEQ ID NO: 141420 - RNA, 82 nt, Human; identical to SEQ ID NO: 140508

SEQ ID NO: 141421 - RNA, 112 nt, Human
cuuuuuccuccagugaacggugacuugacagagguacauaggaggcuacuuguucucuuguuggcugcuuguauuugcuuucuggaagguuauuguuuucaaggaucuuaag

SEQ ID NO: 141422 - RNA, 100 nt, Human
uccuccagugaacggugacuugacagagguacauaggaggcuacuuguucucuuguuggcugcuuguauuugcuuucuggaagguuauuguuuucaagga

SEQ ID NO: 141423 - RNA, 95 nt, Human
uguuuugacucuccgccuucccuuaggucuggaaugguagagcauugaguacuguuaucuuccacaucucaggagaagggggcaguagagagaca

SEQ ID NO: 141424 - RNA, 99 nt, Human; identical to SEQ ID NO: 140790

SEQ ID NO: 141425 - RNA, 82 nt, Human; identical to SEQ ID NO: 140508

SEQ ID NO: 141426 - RNA, 92 nt, Human
aggcugggaacugugacucguacuuguaauccuagugcuuugagaggcugaggcaggaggauugcuugagaccaggaguuugagaccagccu

SEQ ID NO: 141427 - RNA, 90 nt, Human
ggcugggaacugugacucguacuuguaauccuagugcuuugagaggcugaggcaggaggauugcuugagaccaggaguuugagaccagcc

SEQ ID NO: 141428 - RNA, 82 nt, Human; identical to SEQ ID NO: 140508

SEQ ID NO: 141429 - RNA, 92 nt, Human
gggaagggguaauuggcagaguggcacaaucauuuggagaaaggccauauauaugaaacaaugacuuugcuauccugcuaucucucguuccu

SEQ ID NO: 141430 - RNA, 93 nt, Human
ugaugcgccacagguaucagcgucuggaucgccacuucacguuuuagccacaagugacucaguggaagauccagagucaacagaggcucguca

SEQ ID NO: 141431 - RNA, 102 nt, Human
ugagguaggagaaucacuugaacccgggaggcagagguugcggugagccgagauugugccacugcacuccagccugggcaacaagagcgaaacuccgucuca

SEQ ID NO: 141432 - RNA, 75 nt, Human
ccuggucuuuaagagugauuggaggcugggcaugguggcuuaugccuguaaucccagcacuuugggaggccaagg

SEQ ID NO: 141433 - RNA, 103 nt, Human
agaugggauuauaccuagagccucauccauauuggacuuagacaauuuagaugaaauuggagacuuuagcucaguguggaggcgcacaccuguagucccagcu

SEQ ID NO: 141434 - RNA, 128 nt, Human; identical to SEQ ID NO: 140901

SEQ ID NO: 141435 - RNA, 109 nt, Human; identical to SEQ ID NO: 141417

SEQ ID NO: 141436 - RNA, 113 nt, Human
gaauaaauaagcugcucuaauugccaagaauucacaugugguuguaugcagcuuuacugggagacugaaguguaucugcaugugauucugcugugauggacacuuguaaguuu

SEQ ID NO: 141437 - RNA, 101 nt, Human; identical to SEQ ID NO: 140651

SEQ ID NO: 141438 - RNA, 113 nt, Human
gaucauggccguuuuagucguuagugcuacuguaacaaaauaccgcaggcuggggggcuugcaagcaacagagguucauuuaugcaguucugcacgcuggcaagucggagauc

SEQ ID NO: 141439 - RNA, 76 nt, Human
guguuuggaauagagcccagucugaaauuauaagcacugggguacuccuaugugucugggacucuaugccaaguau

SEQ ID NO: 141440 - RNA, 93 nt, Human
ccaaguagaagcaaacuguaguuugaugcuagaacacuauucuuugagaggguaugugugauacucgaaaugcagucauggcucacggcuugg

SEQ ID NO: 141441 - RNA, 106 nt, Human
uggugauugucuguggguauugauaguuaauugucugugaguaccugacagcaacggguuauggcuauugaugacaauugguaccuucagugcccaagcauagcca

SEQ ID NO: 141442 - RNA, 105 nt, Human; identical to SEQ ID NO: 140503

SEQ ID NO: 141443 - RNA, 91 nt, Human; identical to SEQ ID NO: 140592

SEQ ID NO: 141444 - RNA, 110 nt, Human
ucuggcuaugucuggaguuuuuagagagugaguccaugugaggaugguuaguaugucugaaucacacacuacacucucuauaguuuucucucuagaauuuuuuaaacagg

SEQ ID NO: 141445 - RNA, 76 nt, Human
cacugccaacugaggcaggagggcucaggagagucuucgccucuuguacccuccuugggccucuccaaaaccagug

SEQ ID NO: 141446 - RNA, 88 nt, Human
cuuggcuggguuuuuccacgugagauggugucauauugcuggguccagcacccaguuauuguggcccaauuuccuauacccugccuag

SEQ ID NO: 141447 - RNA, 82 nt, Human; identical to SEQ ID NO: 140508

SEQ ID NO: 141448 - RNA, 111 nt, Human; identical to SEQ ID NO: 140513

SEQ ID NO: 141449 - RNA, 72 nt, Human
aggugacugcacagaaaugucuacacauguguuuucacauacauaugucuacccaugccuguguggacacuu

SEQ ID NO: 141450 - RNA, 130 nt, Human
cucuuggccuggccuccugcagugccacgcuccguguauuugacaagcugaguuggacacuccaugugguagagugucaguuugucaaauaccccaagugcggcacaugcuuaccagcucuaggccaggg

SEQ ID NO: 141451 - RNA, 89 nt, Human
ggagaaucgcuugaacccaggaaguggagguugcagugagccaauauugugccauugcacuccagcuugggcaacaagagcgaaacucc

SEQ ID NO: 141452 - RNA, 77 nt, Human
ucgcuugaacccaggaaguggagguugcagugagccaauauugugccauugcacuccagcuugggcaacaagagcga

SEQ ID NO: 141453 - RNA, 72 nt, Human
aggcauugucuccaacauguaccacuggucuggcuuuuguuaggcccauuaauaguguacaugugacagccu

SEQ ID NO: 141454 - RNA, 110 nt, Human
guugugaucccugugcuuugagaagagaacacagugcccagauuauuuaucauuuuugaauuugggaauugugauuuccuccaacguagcugaaaaauaggggcuauagc

SEQ ID NO: 141455 - RNA, 112 nt, Human
ggcucaguucgccagauaacucaacuuucccauuggcuaccuuugggucaggugaucuccacuagaccuaucgccuaugccugauggugggucacauggugcaaauguugcc

SEQ ID NO: 141456 - RNA, 112 nt, Human
acuacuggguguauaaauguguuuguguguguauguauuuauagauguucuuuaagguacccuugaaaacucuacauuauguaugccacauaaugacauuucagucaguggu

SEQ ID NO: 141457 - RNA, 69 nt, Human
ccugaacccaggaggcggaggcugcagugggccaagauuaagccacugcacuccagccugggcaacagg

SEQ ID NO: 141458 - RNA, 110 nt, Human
ucaaacagcuguggucaugucauuucaguuugcaguuucucucaccucagaaaaauaaauugugugggggagaugaacuuuuuuaaacuggaauuuuauuagcugauuga

SEQ ID NO: 141459 - RNA, 69 nt, Human
cuugaaccugaaaggcagaggcugcggugagcugagauugcgccauugcacuccagccugggcaacaag

SEQ ID NO: 141460 - RNA, 96 nt, Human
cggggauucagucugugaggcgggaagcccacuaggaggacucucacuuugcugagucucucuuucccuucuuucuucuucacccaauaaacccug

SEQ ID NO: 141461 - RNA, 75 nt, Human
uuguuuuguuuugagacagagucucgcucagcugcccuggccggaguguagucucaugaucucagcucacugcaa

SEQ ID NO: 141462 - RNA, 91 nt, Human
gauaggauagaugguucugaguggcuuucaacacugacuacuauucucuuuuagccagcagugaguagcuuacucagaauuguccccuauc

SEQ ID NO: 141463 - RNA, 101 nt, Human
ugaggcaggagaaucacuugaacccaggaggcagagguugcagugagcugagaucaugccacugcacuccagccugggcaacagagugaggcuccuucuca

SEQ ID NO: 141464 - RNA, 106 nt, Human
cucauggucuccaaaggucucuacccagacauuucaacuuuguuguucuuuggcuacaaagaacaggagaaauggaggacuucugugggaguguggagacagugag

SEQ ID NO: 141465 - RNA, 82 nt, Human; identical to SEQ ID NO: 140508

SEQ ID NO: 141466 - RNA, 82 nt, Human; identical to SEQ ID NO: 140508

SEQ ID NO: 141467 - RNA, 84 nt, Human
gcaaggugcuagguuuuuuccuuuccccaccugucucuuagccuggggaauuaaaugagaagccuuagaauggguggcccuugu

SEQ ID NO: 141468 - RNA, 77 nt, Human
uucuucacaugaggaggaaucagggucuugaccccuggacacuuaaccuuaggacccauuucuucacaugaggagga

SEQ ID NO: 141469 - RNA, 82 nt, Human; identical to SEQ ID NO: 140508

SEQ ID NO: 141470 - RNA, 97 nt, Human
caugaugccccugagaugguaugcacaauuccaugacaauaugcccuuucuggggagauaguccauaauguucugcuaaauuucaaaugggcucgug

SEQ ID NO: 141471 - RNA, 100 nt, Human
gaggcaggagaauugcuugaaccugggaggcggagguuguggugagccaaggucgcgccauugcacuccagccugggcaacaagggcaaaacucugucuc

SEQ ID NO: 141472 - RNA, 96 nt, Human
caaguuuggucaaggggugaguguguccgacuccaaggagcaucuccguuucugagugggaacucucaugacacugugucccuugccucaggcuug

SEQ ID NO: 141473 - RNA, 77 nt, Human
ugcgggcaggaucacauauuaggcagaaaacaauuccaagcaaggagaguugcugggauuauucugcucuggucgca

SEQ ID NO: 141474 - RNA, 82 nt, Human; identical to SEQ ID NO: 140508

SEQ ID NO: 141475 - RNA, 82 nt, Human; identical to SEQ ID NO: 140508

SEQ ID NO: 141476 - RNA, 101 nt, Human
gacagucucuguucucugacagcuuaguccaugggagagacagucauaccaaugaccucuagcucccaguguccuaagugucaugaaacagaggguagguu

SEQ ID NO: 141477 - RNA, 89 nt, Human
ucucuguucucugacagcuuaguccaugggagagacagucauaccaaugaccucuagcucccaguguccuaagugucaugaaacagagg

SEQ ID NO: 141478 - RNA, 113 nt, Human
uuuugguaaagacauucaucucagucguuucucucucccagcuugaccuuagguuaauauuucauuugggucaagaaaagaauauguaggagagcuauguugcuuuaacaaga

SEQ ID NO: 141479 - RNA, 92 nt, Human
gcuguccugaggccuggagauacuagaggguaaaggaauggaaccaugucuggggucccuuuaguaacuugcagggucugggaauugacugc

SEQ ID NO: 141480 - RNA, 79 nt, Human
uccugaggccuggagauacuagaggguaaaggaauggaaccaugucuggggucccuuuaguaacuugcagggucuggga

SEQ ID NO: 141481 - RNA, 95 nt, Human
uggcaggaggccagcucucauccuuuucugcaaccuguuugcucacugguuuauuuguaaauuggggcuaugagggucuacugcugucccugcca

SEQ ID NO: 141482 - RNA, 100 nt, Human
aggcugcugauucccuuuauuugguaauggggugugugcaguacguugauuaaaaaauaugcauuuccauuccauugcuuuugaaggggggcaguugucu

SEQ ID NO: 141483 - RNA, 101 nt, Human
ugaggugggaggauuacuugagcccaagaggaggaggcugcagugagucaacauugcaccacugcacuccagccugggcaacagagugugaccccaucuca

SEQ ID NO: 141484 - RNA, 99 nt, Human
gaggugggaggauuacuugagcccaagaggaggaggcugcagugagucaacauugcaccacugcacuccagccugggcaacagagugugaccccaucuc

SEQ ID NO: 141485 - RNA, 104 nt, Human
uaugggaaaaaaggcaguuuagaaaaaaguacauuugguauacaugcauagagaugugcauagcaaauggucugaaugaauggccuuagaccacaguuuucaua

SEQ ID NO: 141486 - RNA, 91 nt, Human
ugggaaaaaaggcaguuuagaaaaaaguacauuugguauacaugcauagagaugugcauagcaaauggucugaaugaauggccuuagacca

SEQ ID NO: 141487 - RNA, 94 nt, Human
aggcaccuagagacuucacaagcuaauggcagucccuggagcaggaagcaacuuguuauucugcucaagagaauccaccagcagcucuuggccu

SEQ ID NO: 141488 - RNA, 117 nt, Human
uugggaaacugagguaggagaaucacuugagccccggaggcagggguugcagugagcugagauugugccacugcacuccagccugggcaacagagugaaacuccaucaucaucucaa

SEQ ID NO: 141489 - RNA, 88 nt, Human
ggagaaucacuugagccccggaggcagggguugcagugagcugagauugugccacugcacuccagccugggcaacagagugaaacucc

SEQ ID NO: 141490 - RNA, 72 nt, Human; identical to SEQ ID NO: 141449

SEQ ID NO: 141491 - RNA, 85 nt, Human
cuuaaguuugcuugcaguguauguguguaugucugugugugcaugcacgcacaugugcacaugcagcagggagaguggaauuaag

SEQ ID NO: 141492 - RNA, 90 nt, Human
gggugugaaggaaacauccucccccuuguuuucaaccuaguaggccaguuuagaaacaagccacagggaagguguugucagucauuacuc

SEQ ID NO: 141493 - RNA, 105 nt, Human
gggagaggcauugugagggagagaggugucaggaaugaaagaaugucuuaaaauucuaagcagucuuucuucuucuucucuuuauuaacagcaauuaacucucuc

SEQ ID NO: 141494 - RNA, 103 nt, Human
ggagaggcauugugagggagagaggugucaggaaugaaagaaugucuuaaaauucuaagcagucuuucuucuucuucucuuuauuaacagcaauuaacucucu

SEQ ID NO: 141495 - RNA, 101 nt, Human
gagaggcauugugagggagagaggugucaggaaugaaagaaugucuuaaaauucuaagcagucuuucuucuucuucucuuuauuaacagcaauuaacucuc

SEQ ID NO: 141496 - RNA, 103 nt, Human
acaguauagucuuccacagucuccugucucuuuuauaagguguccuaugagacuaauaauaucuuucuuaggggacuguugagaagguggaauuuugcacugu

SEQ ID NO: 141497 - RNA, 76 nt, Human; identical to SEQ ID NO: 140663

SEQ ID NO: 141498 - RNA, 78 nt, Human
ggccaccugcugccuauucccuggcacuucauucuucugauaauggaguaugagagagaaugggacaugagguggacc

SEQ ID NO: 141499 - RNA, 74 nt, Human
gucccaaagaaaaggaaaacccagcaagggcaugguccaucugcugccuuuucugggcucccuuuucugcugac

SEQ ID NO: 141500 - RNA, 83 nt, Human
ugcuucucucucaaguucuaguaacuucaggguaguuuuauugucuuugaauaguuacugcuuauaccuuugugggggaagca

SEQ ID NO: 141501 - RNA, 82 nt, Human; identical to SEQ ID NO: 140508

SEQ ID NO: 141502 - RNA, 73 nt, Human
cuuugugaguggcuuugaaacuguaaugagcgcaguuuacugagucauuacuagucucgacccauucguagag

SEQ ID NO: 141503 - RNA, 111 nt, Human
guuuggaggucuguugcuuccuugaggcacgguaaggagugguuccaauuuggggugcucacgggauccacagaucucuccuuucuuuccucugccuccccaucuccugau

SEQ ID NO: 141504 - RNA, 98 nt, Human
gugucuggcuucucacucagcgugcugucucugaguggccugugcugucaugcacuggugccaccuuccuuuugcacugccgaguguucucaguacac

SEQ ID NO: 141505 - RNA, 81 nt, Human
ggcaaccacagcaucagugacagcggcuucucccccggcuuccugggcugagccacacuguccugaugccaccaggucacc

SEQ ID NO: 141506 - RNA, 71 nt, Human
gcgaaucucucagugcgccagugaggggaaugggaaccugaccccaucuuuucauccacugagagaaaagc

SEQ ID NO: 141507 - RNA, 108 nt, Human
gagagaggaaaugagaggagucggcuggggcgaguguggaccgcagcccagaguuagucuuggcugcagugcaacucuuucuaaaauguuauucucacgcccuuucuu

SEQ ID NO: 141508 - RNA, 106 nt, Human
agagaggaaaugagaggagucggcuggggcgaguguggaccgcagcccagaguuagucuuggcugcagugcaacucuuucuaaaauguuauucucacgcccuuucu

SEQ ID NO: 141509 - RNA, 108 nt, Human
ggcauuagguuucagucacagccaagcaaguguggacagugaguaaugucugaagauuccauagcuugaucacagcuacuuuuguccugcugucugaacuccauuguc

SEQ ID NO: 141510 - RNA, 113 nt, Human
gugggaaauguguucugaugagagggaggcaauccauaaugugccccuuuguaugcagggugggcaaaacacugcuuccaacuaguuacgucuaagauacuagguuaucccac

SEQ ID NO: 141511 - RNA, 124 nt, Human
uucagguacuccaugugauauaugguuccacaauccucagcguguuaacugaagccuuguugaguuuaacaaagcugccauugaagaucuggggaaagugaagaaguugcaacagaguuuuggg

SEQ ID NO: 141512 - RNA, 120 nt, Human
cagguacuccaugugauauaugguuccacaauccucagcguguuaacugaagccuuguugaguuuaacaaagcugccauugaagaucuggggaaagugaagaaguugcaacagaguuuug

SEQ ID NO: 141513 - RNA, 72 nt, Human
cacaauccucagcguguuaacugaagccuuguugaguuuaacaaagcugccauugaagaucuggggaaagug

SEQ ID NO: 141514 - RNA, 62 nt, Human
uccucagcguguuaacugaagccuuguugaguuuaacaaagcugccauugaagaucugggga

SEQ ID NO: 141515 - RNA, 110 nt, Human
cagccucaagugauccaccaccucagcuucccaaagugcugggauuacaggcaugauccaccacgccuggucccauuguucuuuacaucugaugggcugcuuuuggguug

SEQ ID NO: 141516 - RNA, 99 nt, Human
ugaggcaggaaaaucgcuugaacccaaggcagagguugcagucagcagauauugcaccacugcacuccagccugggcaacaaagcaagacucugccuca

SEQ ID NO: 141517 - RNA, 112 nt, Human
ccuuugaacaguggaacuggaugaaagaaaugggaucugugcagcuacuucaguuagcuggaauccuacaguucugguuucuucuuuaaugcuaguuuucccuuuucagagg

SEQ ID NO: 141518 - RNA, 88 nt, Human; identical to SEQ ID NO: 140946

SEQ ID NO: 141519 - RNA, 82 nt, Human
cucuugaccagagguucucaaaugagggacauuuuaccugccggggacauuuccaauguuuggggacacuuuugguuaucag

SEQ ID NO: 141520 - RNA, 88 nt, Human; identical to SEQ ID NO: 140946

SEQ ID NO: 141521 - RNA, 98 nt, Human
ggcacuuggaaccgucuuggggaauauagcuugguaauugaacugcuuaagcuuauuauuaauauuuaagcuauaguuccaggcccauuccagagguc

SEQ ID NO: 141522 - RNA, 91 nt, Human
uucacucccaaguggcuuuugucuggcagauuccgguggauuaugcaaagagggacugccagagaaucugagcuguuggaagacuucugaa

SEQ ID NO: 141523 - RNA, 99 nt, Human
auggcgaccauaugaccuuauucuuuagguuuagacacaagggauuuccuugguuuggugacagaaagguaagaguuauauuaccaucaaggucaccau

SEQ ID NO: 141524 - RNA, 72 nt, Human
gaaaagggcugaucaguauuuucugauccuaguucagugcuagucagggagacugucaguaaagaccuuuuu

SEQ ID NO: 141525 - RNA, 99 nt, Human; identical to SEQ ID NO: 141516

SEQ ID NO: 141526 - RNA, 97 nt, Human; identical to SEQ ID NO: 140531

SEQ ID NO: 141527 - RNA, 78 nt, Human
aggcugagugcaguggugugaucucggcucacugcaagcucugccucccagguucacgccauuguccugccucagccu

SEQ ID NO: 141528 - RNA, 89 nt, Human
caguuaagaguauaaugaaagacugaucagcauagaauggugaugacuauaccauuuugugcuggugucuuuuguuguaccguuuuuug

SEQ ID NO: 141529 - RNA, 71 nt, Human
guauaaugaaagacugaucagcauagaauggugaugacuauaccauuuugugcuggugucuuuuguuguac

SEQ ID NO: 141530 - RNA, 101 nt, Human
ugagacaggagaaucgcuugaacccgggagguggagguuacggugagugagaucgcgccauugcacuccagccugggcaacaagagcgaaacuccgucuca

SEQ ID NO: 141531 - RNA, 99 nt, Human
gagacaggagaaucgcuugaacccgggagguggagguuacggugagugagaucgcgccauugcacuccagccugggcaacaagagcgaaacuccgucuc

SEQ ID NO: 141532 - RNA, 88 nt, Human
ggagaaucgcuugaacccgggagguggagguuacggugagugagaucgcgccauugcacuccagccugggcaacaagagcgaaacucc

SEQ ID NO: 141533 - RNA, 82 nt, Human; identical to SEQ ID NO: 141519

SEQ ID NO: 141534 - RNA, 88 nt, Human; identical to SEQ ID NO: 140946

SEQ ID NO: 141535 - RNA, 100 nt, Human
ugaggcaagagaaucacuugaacucaggagguggagguugcagugagccaagaugcaccacugcacuccagccugggcaacagagugagacucugucuca

SEQ ID NO: 141536 - RNA, 81 nt, Human
ggaggggccaggaggaaaugaugagucuuagugaucuggaaacauuccagacuaauuuauuaucuucucuuuuuucccuuc

SEQ ID NO: 141537 - RNA, 99 nt, Human; identical to SEQ ID NO: 141516

SEQ ID NO: 141538 - RNA, 97 nt, Human; identical to SEQ ID NO: 140531

SEQ ID NO: 141539 - RNA, 92 nt, Human
gggaggauugcuugagccuggaagcuggagccugcagugaacuaucauugugccacuguacuccagccuaggcaacaaaaugaaauccuguc

SEQ ID NO: 141540 - RNA, 86 nt, Human
aggauugcuugagccuggaagcuggagccugcagugaacuaucauugugccacuguacuccagccuaggcaacaaaaugaaauccu

SEQ ID NO: 141541 - RNA, 94 nt, Human
aggaguacgacgcugugguagcuaugaucaugccacugcacuccagccugggugacagagcaagaucuagauaauuacagucuguccugcuccu

SEQ ID NO: 141542 - RNA, 92 nt, Human
ggaguacgacgcugugguagcuaugaucaugccacugcacuccagccugggugacagagcaagaucuagauaauuacagucuguccugcucc

SEQ ID NO: 141543 - RNA, 93 nt, Human
gcaggaggauugcuugagcccaggaguucaaggcuacaaugagcuaugaucacacuacuacacuccagccugggcaacagagcaagacccugu

SEQ ID NO: 141544 - RNA, 88 nt, Human
aguccucuuaugcuguugacauuuccccaugugaugcuauugcuucucuuuggaggcuaagcaguaaaugggguuaacagcaagggcu

SEQ ID NO: 141545 - RNA, 72 nt, Human
ugcuguugacauuuccccaugugaugcuauugcuucucuuuggaggcuaagcaguaaaugggguuaacagca

SEQ ID NO: 141546 - RNA, 110 nt, Human
uguugauauguggcagugcaggguugcaagagagaguagaagcaugcaaggccuccucaggcuuugacucagaaauggaacgaugucacuucugccauaugcuauuggca

SEQ ID NO: 141547 - RNA, 101 nt, Human; identical to SEQ ID NO: 141139

SEQ ID NO: 141548 - RNA, 82 nt, Human; identical to SEQ ID NO: 140508

SEQ ID NO: 141549 - RNA, 88 nt, Human
ggggcuucuucccuggcaggauuccugggauuucaaacuaccucaccaacaggacgcugaaccaggagccugccacccaacuggcccc

SEQ ID NO: 141550 - RNA, 82 nt, Human; identical to SEQ ID NO: 140508

SEQ ID NO: 141551 - RNA, 89 nt, Human
gcuuggcaucaguuucauuuugcaaaacauggcuuugauaauugcaucagaucugcaaggcuguguaggcagaauucuuauugccaagu

SEQ ID NO: 141552 - RNA, 99 nt, Human
gaggcaggagaaucacuugaacccgggaggcugaggguacagugagccgagaucaugccacugcacucuagccucggugaccgaaggagacucugucuc

SEQ ID NO: 141553 - RNA, 104 nt, Human
gcuaguguggacacacagcucuuggaaagcauguacauuuggaggauauagugucuucuaaauaauuauacacuuucuaugagaguaggguggcuuacaguggc

SEQ ID NO: 141554 - RNA, 130 nt, Human
ucuuuucuuugguaggcuagccuucgagacugcauuacccuccccaacuuaaaaucuuuugauaacccaggcagcuggguuauccccaauuuaaagucuuuuuguuguagcuguauggcauuuaucuaga

SEQ ID NO: 141555 - RNA, 82 nt, Human; identical to SEQ ID NO: 140508

SEQ ID NO: 141556 - RNA, 104 nt, Human
gcuugguaugcucagaagcugcuaaaguguguaugggcaggugugggggcaauuucuugguccuagcacuuccauauaucgacuuucuuuucuggcugcuaagu

SEQ ID NO: 141557 - RNA, 84 nt, Human
guagagaaccucaucaugagauuugagaauagcuuuagaguuacucuugggauagugucucauggcccugugagggaacucuac

SEQ ID NO: 141558 - RNA, 96 nt, Human; identical to SEQ ID NO: 140607

SEQ ID NO: 141559 - RNA, 94 nt, Human; identical to SEQ ID NO: 141541

SEQ ID NO: 141560 - RNA, 92 nt, Human; identical to SEQ ID NO: 141542

SEQ ID NO: 141561 - RNA, 105 nt, Human
gggccaaaaauucaagaugcucauuugcaaguugucuucuaggguguugccugaaccuaggcugcaguagaaguggggcuuggagguaggcgauauugaaauccc

SEQ ID NO: 141562 - RNA, 80 nt, Human
cagcuugcagcacacacagcauuggucaugaggucagcugcucucugacccacuugcucagaguuguuugcugccuguug

SEQ ID NO: 141563 - RNA, 82 nt, Human
ccuggggucugacgugugugcgugugaguguguauacaugcuuaacguauaucacguuacuucaccuaugucaguaaccagg

SEQ ID NO: 141564 - RNA, 80 nt, Human; identical to SEQ ID NO: 141562

SEQ ID NO: 141565 - RNA, 93 nt, Human
gggcugggcaagauggcucauguuuguagucucaguacuuugggaggccaaagaugggaggauugcuugagcccgugaguuugagaccagccu

SEQ ID NO: 141566 - RNA, 82 nt, Human; identical to SEQ ID NO: 140508

SEQ ID NO: 141567 - RNA, 98 nt, Human
gagaugggagaaucacuuaagcccaggaauuugaggcugcagugagcaaugacugugccacuguacuucagccuggguaacagaggggacuucauuuc

SEQ ID NO: 141568 - RNA, 87 nt, Human
ggagaaucacuuaagcccaggaauuugaggcugcagugagcaaugacugugccacuguacuucagccuggguaacagaggggacuuc

SEQ ID NO: 141569 - RNA, 84 nt, Human
gaaucacuuaagcccaggaauuugaggcugcagugagcaaugacugugccacuguacuucagccuggguaacagaggggacuuc

SEQ ID NO: 141570 - RNA, 112 nt, Human
ugguuccucgacaggcagauaaucaugucuucuuuguuuagagaugaauaaacaccuagcauggugcucugaauauaguaugugcuuaacaaaugcuuguuggauugaacca

SEQ ID NO: 141571 - RNA, 87 nt, Human
aggcugggaacauucagggcugcucaagcccaggguuggcaacccccacucccuccaacacaagcagcucaagucuucuccagaccu

SEQ ID NO: 141572 - RNA, 106 nt, Human
caacaccucuggccuggcagaggcccugagcagaugugagcugguuaccacgggguuaucaacucuggcauuuguugguuuaugcggcaguaggacagaauauuug

SEQ ID NO: 141573 - RNA, 89 nt, Human
ccucuggccuggcagaggcccugagcagaugugagcugguuaccacgggguuaucaacucuggcauuuguugguuuaugcggcaguagg

SEQ ID NO: 141574 - RNA, 96 nt, Human
cuguccuguagauacaugggggaugaucauaagugagcuuuuauaagcgcagaguauuaccuauaucaccgugaaaguguaucgcauacaggacag

SEQ ID NO: 141575 - RNA, 106 nt, Human
ggucucccucuugcccaggcuggagugcagugaugcaaucauaguucacugcaaccuucuggguucaagugauuuuccugccucagccucccaaguaguugagacu

SEQ ID NO: 141576 - RNA, 96 nt, Human; identical to SEQ ID NO: 140607

SEQ ID NO: 141577 - RNA, 94 nt, Human; identical to SEQ ID NO: 141541

SEQ ID NO: 141578 - RNA, 92 nt, Human; identical to SEQ ID NO: 141542

SEQ ID NO: 141579 - RNA, 96 nt, Human; identical to SEQ ID NO: 140607

SEQ ID NO: 141580 - RNA, 94 nt, Human; identical to SEQ ID NO: 141541

SEQ ID NO: 141581 - RNA, 92 nt, Human; identical to SEQ ID NO: 141542

SEQ ID NO: 141582 - RNA, 76 nt, Human
gagccauuaaucucggggucucagccucucuuaacggaccuuccaggcacugcugagaaaaccagguuaaugguuu

SEQ ID NO: 141583 - RNA, 100 nt, Human
ugaggcaggagaaucgcuugaaccuggcagguggagguugcagugagccgagaucgcaccauugcacuccagccugggcaacaagcacaaaacugucuca

SEQ ID NO: 141584 - RNA, 98 nt, Human
gaggcaggagaaucgcuugaaccuggcagguggagguugcagugagccgagaucgcaccauugcacuccagccugggcaacaagcacaaaacugucuc

SEQ ID NO: 141585 - RNA, 99 nt, Human
gaggcaggagaauggcgugaacccgggaggcggagcuugcagugagccgagaucaugccacugcacuccagccugggcaacagagcgagacuccgucuc

SEQ ID NO: 141586 - RNA, 89 nt, Human
ggagaaucacuugaacccaggagguggagguuguagugagcugagauugcaccacugcacuccagccugggcgauaagagugaaacucc

SEQ ID NO: 141587 - RNA, 110 nt, Human
ugaggcgcccugaaaacauaggcugggcuugugugagaugggagaaagaccagaaguaucgucuaaacuucucccugcccacacauccagcuucauggcacugugcuaca

SEQ ID NO: 141588 - RNA, 82 nt, Human; identical to SEQ ID NO: 141563

SEQ ID NO: 141589 - RNA, 130 nt, Human
cagcgcggcucccgccacccucaauaaauguugcuuggaguggaccgaggcucugcaggaaugcagggagggccgggcuccgccccaggguuauuucuaaguugaggacaggagguugugaguucugcug

SEQ ID NO: 141590 - RNA, 99 nt, Human
ucgggagggauggugaguuccugucauccucuaacucacauuaaaggacaaaugagaggggcaggguggcagguggccauggauuguugucccaacuga

SEQ ID NO: 141591 - RNA, 91 nt, Human; identical to SEQ ID NO: 140586

SEQ ID NO: 141592 - RNA, 107 nt, Human
ucacauucuccauaacuggauaugagggaagcaugggaccaugaucccuggagggacugcagggauugcccacgcuagucaucucacuguacagcuggagaaacuga

SEQ ID NO: 141593 - RNA, 114 nt, Human
agaauugagguuuguggcuucgcuguuccuguagggugcaugacaagaucccuucucuugagaaaggaaaaaauugaucacccuagcagcagugaugcauagaaaccuaauuuu

SEQ ID NO: 141594 - RNA, 109 nt, Human
gagaccucuaucuauaaaaaaugaggcaggaguuggcaagaggucaagacugcaaugagccaugauccugccacuauacuccugccugggugaugggagacccugucuc

SEQ ID NO: 141595 - RNA, 99 nt, Human; identical to SEQ ID NO: 141590

SEQ ID NO: 141596 - RNA, 130 nt, Human; identical to SEQ ID NO: 141589

SEQ ID NO: 141597 - RNA, 82 nt, Human; identical to SEQ ID NO: 141563

SEQ ID NO: 141598 - RNA, 107 nt, Human
ccauggccuggugaggaaaucagaguguguuuugcuuuguauucuauucccaccucaaaggcaggauuaaaguagcacugcuugucacgucucauuauggaaaucgg

SEQ ID NO: 141599 - RNA, 91 nt, Human; identical to SEQ ID NO: 140586

SEQ ID NO: 141600 - RNA, 74 nt, Human
cccacaggugauucuguugugcagccaugguuggcaggcuguucacggugcuguucaacagguccugcuguggg

SEQ ID NO: 141601 - RNA, 82 nt, Human
ugugccugccccaaucuuguguuuuauugcuggccaccuguagccaggcacugugcaggaugaugggauccagcaguguaca

SEQ ID NO: 141602 - RNA, 99 nt, Human
ugagacagaagaaucgcuugaacucgggcggcggaaguugcagugagcugagauugcaccacugcacuccagccugggcaacagugagacucugucuca

SEQ ID NO: 141603 - RNA, 97 nt, Human
gagacagaagaaucgcuugaacucgggcggcggaaguugcagugagcugagauugcaccacugcacuccagccugggcaacagugagacucugucuc

SEQ ID NO: 141604 - RNA, 74 nt, Human
ucgcuugaacucgggcggcggaaguugcagugagcugagauugcaccacugcacuccagccugggcaacaguga

SEQ ID NO: 141605 - RNA, 77 nt, Human
aaauuuugggggaauuuuacugcccuagaggacugguucuagccacuuucccagggcaguggaucucugcaaaguuu

SEQ ID NO: 141606 - RNA, 91 nt, Human; identical to SEQ ID NO: 140586

SEQ ID NO: 141607 - RNA, 99 nt, Human
gaggcaggagaaucauuugaaccugggaaguggagguugcagugagccaagaucgugucacugcacucuagccuaggugauaaagcgagacucagucuc

SEQ ID NO: 141608 - RNA, 82 nt, Human
gcacagugagagaaacagacuccaccacaccuucuuggcugugcaaggaagucagaugauguuggagucugugcuacugugc

SEQ ID NO: 141609 - RNA, 105 nt, Human
gaggcugaggaaagaagauugcuugagcccaggaauuagaggcugcaaugagcuaugaucaugccacugcacuccauccuggggagcagagcuagacucugucuc

SEQ ID NO: 141610 - RNA, 101 nt, Human
ugaggcaggagaaucacuugaacccgggagguggagguugcagugagcugagauugcgccacugcacuccagccugggcaacagagcgagacuccaucuca

SEQ ID NO: 141611 - RNA, 99 nt, Human
gaggcaggagaaucacuugaacccgggagguggagguugcagugagcugagauugcgccacugcacuccagccugggcaacagagcgagacuccaucuc

SEQ ID NO: 141612 - RNA, 88 nt, Human
ggagaaucacuugaacccgggagguggagguugcagugagcugagauugcgccacugcacuccagccugggcaacagagcgagacucc

SEQ ID NO: 141613 - RNA, 88 nt, Human
ggagaauugcuugcacccaggaggcagagguuguggugagcugagaucgucccauugcacuccagccugggugacagggcgaaacucc

SEQ ID NO: 141614 - RNA, 95 nt, Human
ggaugguuuggggaagagaaugugcauggaucgcucagaacugacccagaggcaaugaguauuugugugccauguggauucucuccaaaaugucc

SEQ ID NO: 141615 - RNA, 82 nt, Human; identical to SEQ ID NO: 140508

SEQ ID NO: 141616 - RNA, 99 nt, Human
gagacaggagaaucacuugaauccgggaggcaaagguugcagugugucaagaucacaccacugcacuccagccugggcaacagagugagacuucaucuc

SEQ ID NO: 141617 - RNA, 90 nt, Human
guuaugaagcuuguaggggguuuagcuccacagggucagaccugcaggugcaaacaggcccuaggcgaacccccuggaggaaacguugac

SEQ ID NO: 141618 - RNA, 88 nt, Human; identical to SEQ ID NO: 140582

SEQ ID NO: 141619 - RNA, 106 nt, Human
agagagggaccagcucuuggcaaucaauggggucucuugcaccaaccucucccaugccagugccaugagccucaucgaugccucaggaaaucagcuuguccucacu

SEQ ID NO: 141620 - RNA, 95 nt, Human
ggaccagcucuuggcaaucaauggggucucuugcaccaaccucucccaugccagugccaugagccucaucgaugccucaggaaaucagcuugucc

SEQ ID NO: 141621 - RNA, 82 nt, Human; identical to SEQ ID NO: 140589

SEQ ID NO: 141622 - RNA, 105 nt, Human; identical to SEQ ID NO: 141609

SEQ ID NO: 141623 - RNA, 96 nt, Human
ggaauaagaaaggcaacguuuugcagcuuccaaauuucugaagaaacuaaucucagauuggcaguuaaagucaaaauguugccaaauauuuauucc

SEQ ID NO: 141624 - RNA, 93 nt, Human
gucuggcauucccuagugagaugaacccgguaccucagauggaaaugcagaaaucacccaucuucugugucgcucaugcugggagcuguagac

SEQ ID NO: 141625 - RNA, 101 nt, Human
gaaugauuugaagggggcagucagagaaguaggaauaucaggagugguggucugauuacucugagaugugucuugauucuauuuuguuuucuuugaaauuc

SEQ ID NO: 141626 - RNA, 82 nt, Human
cuguuguuaaaaccugcuuccccacugcucagccugccaucagccauccagcugcagagcaguggagaguaggucucaccag

SEQ ID NO: 141627 - RNA, 105 nt, Human; identical to SEQ ID NO: 141609

SEQ ID NO: 141628 - RNA, 99 nt, Human
ugguugaggccaggaauucgagacaagucugggcaacaaagugagaucccaucucuacaaaaaauuagccagacuggugggcucccuuagccucagcua

SEQ ID NO: 141629 - RNA, 101 nt, Human
caaugggggacauuugccaagaguugagaaugcuguaauuggaggccugagaggugggucccaauucuuacauuuuccauuccacaaacugucuccuuuug

SEQ ID NO: 141630 - RNA, 73 nt, Human
aguggcaggugugcaaaucacaacuuggccucccaaacuaagguacaaaguugugagucacacgucugccacu

SEQ ID NO: 141631 - RNA, 107 nt, Human
ccuuuaaugaagcugaacgcugucccagcaauucccuccacagaagaccuacugucaccaccucuggaggggcaauuccuggaggaaccaagucagccaaucgaagg

SEQ ID NO: 141632 - RNA, 91 nt, Human
ugcaaagagcccucacacuggugaguauaaaugugcuaugugagcaacucuaaaacccacaauacucaaccacuguggugggaugauugcg

SEQ ID NO: 141633 - RNA, 85 nt, Human
gggcugacuuggacucugaaauguuaagcaacuugcucuccaggaguccugugaagaaguugcuucauccuuuugaagucugccc

SEQ ID NO: 141634 - RNA, 100 nt, Human
gcgagaggugaugguuuuaaagcgcggcacuuccucauucucgcacacacgcccuccugcugcccaugaagaaggugucugcuuucccuucgccuuccgc

SEQ ID NO: 141635 - RNA, 86 nt, Human
uggagcugagauucugugggugagagagugggagagugucugugggcugagcacugguccuuucugacucacagcucuggggccca

SEQ ID NO: 141636 - RNA, 110 nt, Human
ccaauccccaaccccugcagugcuuugauuaugagaaaguucugcaugacuuagcauaacugcucuuuucuaaaagccucugcaauuagauccaaaggguugggguuugg

SEQ ID NO: 141637 - RNA, 98 nt, Human
cccaaccccugcagugcuuugauuaugagaaaguucugcaugacuuagcauaacugcucuuuucuaaaagccucugcaauuagauccaaaggguuggg

SEQ ID NO: 141638 - RNA, 82 nt, Human; identical to SEQ ID NO: 140589

SEQ ID NO: 141639 - RNA, 88 nt, Human
ggagaauugcuugaaccugggaggcagagguugcagugagcugagaucacgccauugcacuccagccugggcaacagagcgagaaucc

SEQ ID NO: 141640 - RNA, 110 nt, Human
guccauccuuugaacaugacuccugguguguuagucuagucuguucucaugcugcuaauaaagacauaccugagacuggcuaauuuauaaaggaaagagguuuaauggac

SEQ ID NO: 141641 - RNA, 100 nt, Human
gaggcaggagaaucgcuugaacccgggaaguggagguugcagugagccgagaucuugccauuguucuccagccugggcgacaagagugaaacuccaucuc

SEQ ID NO: 141642 - RNA, 89 nt, Human
ggagaaucgcuugaacccgggaaguggagguugcagugagccgagaucuugccauuguucuccagccugggcgacaagagugaaacucc

SEQ ID NO: 141643 - RNA, 94 nt, Human
gagggagccacggucagauuucaaguggucauuucacucuuucucccucugggggacugagacaugauuaacuugcaauaauugugacucccuc

SEQ ID NO: 141644 - RNA, 101 nt, Human
ggcuaagucaugagaauugcuugaacccaggcaucggagguugcagugagccgagauugcaccaaugcacuccagccugggcgacagagcgagacuccguc

SEQ ID NO: 141645 - RNA, 86 nt, Human
gagaauugcuugaacccaggcaucggagguugcagugagccgagauugcaccaaugcacuccagccugggcgacagagcgagacuc

SEQ ID NO: 141646 - RNA, 105 nt, Human
uucugcugucuauuaugagucugacuggcacagacaucugucaaggaagaaggauucuuugagcguauuugugucagucaacugcauauauggaccacaacagaa

SEQ ID NO: 141647 - RNA, 95 nt, Human
ggucagugcuuuaagugaaucuacucagagcugugaaaucuugggggaauuugacccagucacaguugagagaagguucuggaaggauaugggcu

SEQ ID NO: 141648 - RNA, 82 nt, Human; identical to SEQ ID NO: 140508

SEQ ID NO: 141649 - RNA, 91 nt, Human
ucccuguccugucuucgaguauuuguuuuuaaugcugggugucgaucgagacaacaagcgcucagagcaaagcaaggaugcauuacggggg

SEQ ID NO: 141650 - RNA, 100 nt, Human
ugcugcauccugccuggcucccaggaggccucucucagcauuuucugacaacaaagccggggcugcagaucccuggugagauuccaggcuagcaucagca

SEQ ID NO: 141651 - RNA, 98 nt, Human
gcugcauccugccuggcucccaggaggccucucucagcauuuucugacaacaaagccggggcugcagaucccuggugagauuccaggcuagcaucagc

SEQ ID NO: 141652 - RNA, 82 nt, Human; identical to SEQ ID NO: 140508

SEQ ID NO: 141653 - RNA, 89 nt, Human
ggagaauuguuugaacccacauggcggagacugcggugagcugauaccgcgucauugcacuccagccugggcaacaagagcaaaacucc

SEQ ID NO: 141654 - RNA, 96 nt, Human
ucugagagagagcuggucuugugaucgugggcuggaagauuggcuauuacuaucuaacucaucuacagucagugugaucacagcuaaccucucaga

SEQ ID NO: 141655 - RNA, 112 nt, Human
agggaaaaaauucauaauucagacaggcucucggggcuucaccauacaacgccuuucuuguauuugguuaguuuuaugggccuggaguguugaccauguauuaauuuucucu

SEQ ID NO: 141656 - RNA, 84 nt, Human
agaggauugcuugagcccagggaggucaaggcugcagugauccaugauugcgccccuguacucugggcaacagagcaagacccu

SEQ ID NO: 141657 - RNA, 97 nt, Human
cagcuuugcagcuaaaauacaccagggacauggcuugcucacaucacacggguguggcggagaggguccaugguagagcuuggccugcaggcagcug

SEQ ID NO: 141658 - RNA, 102 nt, Human
ccaguauuguguggggaguguuuugaggucaucuaaugguguugucuauucuucaguagcaacuccaacacccucuacauuugcuaucaccacacaaccugg

SEQ ID NO: 141659 - RNA, 88 nt, Human; identical to SEQ ID NO: 141280

SEQ ID NO: 141660 - RNA, 82 nt, Human; identical to SEQ ID NO: 140508

SEQ ID NO: 141661 - RNA, 100 nt, Human
uaauggggccucguucuucugccacaagugcaucccaccuuuaucuuucagggaagagguugguugcacguuguuaggccaagagacuggcccuccauua

SEQ ID NO: 141662 - RNA, 82 nt, Human; identical to SEQ ID NO: 140508

SEQ ID NO: 141663 - RNA, 100 nt, Human
uccacuacuguuguggcuuuugcaaauuacuaaauuucucugugacuacuuuuccauuucuuaaguaauuugguugguuuccaaaagucaauaaugugga

SEQ ID NO: 141664 - RNA, 95 nt, Human
cuacuguuguggcuuuugcaaauuacuaaauuucucugugacuacuuuuccauuucuuaaguaauuugguugguuuccaaaagucaauaaugugg

SEQ ID NO: 141665 - RNA, 82 nt, Human; identical to SEQ ID NO: 140508

SEQ ID NO: 141666 - RNA, 82 nt, Human; identical to SEQ ID NO: 140508

SEQ ID NO: 141667 - RNA, 82 nt, Human; identical to SEQ ID NO: 140508

SEQ ID NO: 141668 - RNA, 82 nt, Human; identical to SEQ ID NO: 140508

SEQ ID NO: 141669 - RNA, 99 nt, Human
aggcaggaggaucacgugagcccaggaggugaaggcuacagugaagugagaucaugcaacuguacuucagccugggcaacagagcaagauucucuuucu

SEQ ID NO: 141670 - RNA, 90 nt, Human
ggaggaucacgugagcccaggaggugaaggcuacagugaagugagaucaugcaacuguacuucagccugggcaacagagcaagauucucu

SEQ ID NO: 141671 - RNA, 88 nt, Human
gaggaucacgugagcccaggaggugaaggcuacagugaagugagaucaugcaacuguacuucagccugggcaacagagcaagauucuc

SEQ ID NO: 141672 - RNA, 82 nt, Human; identical to SEQ ID NO: 140508

SEQ ID NO: 141673 - RNA, 79 nt, Human
cccugucagagcucuccagaauaugcuuguuggagauccuucaggcaguaagggagaguuuugccuccuuacacagugg

SEQ ID NO: 141674 - RNA, 76 nt, Human
aggccaucuuaaucggggccagagaugacacucucccccuguaacucagccuggcucugucuauugggaugugccu

SEQ ID NO: 141675 - RNA, 77 nt, Human
ggaaaggagugguccagacccugaaggaagcagacaggguaccugggcuuccuugguuugcaagacucacccucucu

SEQ ID NO: 141676 - RNA, 74 nt, Human
gaccucaggaaagcuggguugagcugggcugagacaauuaaugucugucagcccaaacccggcacucugaccuc

SEQ ID NO: 141677 - RNA, 99 nt, Human
gguacaugucacuacuguucauagucucuuugcuggaacuugguccuauggcccuacuggcagagaggaaggcuaugaaacccagucuaggccugcgcc

SEQ ID NO: 141678 - RNA, 82 nt, Human
cagaaggcugcauuuggcaguuucccuuacuucugacccaagccucaugcagggcugugugggugcugccugcagccuuuug

SEQ ID NO: 141679 - RNA, 88 nt, Human
ccucacagccaugaacacaccugggauuccaggaauaggauaccugaaguuacuauucucuaaucccggggucccauuagcauugggg

SEQ ID NO: 141680 - RNA, 82 nt, Human; identical to SEQ ID NO: 140508

SEQ ID NO: 141681 - RNA, 78 nt, Human
cugagaggcagaggcuucagugagccgaggccacaccacugcacuccggccuuggugacagagacucugccucgaaag

SEQ ID NO: 141682 - RNA, 90 nt, Human
guauaacgcaaaacacaauuucuaaauagucaaaaguuuuuccuggcaaggagacuuuuguagacaccuacccugugaucaucugugugc

SEQ ID NO: 141683 - RNA, 101 nt, Human; identical to SEQ ID NO: 141271

SEQ ID NO: 141684 - RNA, 82 nt, Human; identical to SEQ ID NO: 140508

SEQ ID NO: 141685 - RNA, 87 nt, Human
ugcuucuaggaaccuccaucucaugccauggugcuucgaggagcguaccagccuugcagcaccacaacagggacugggcuggaggca

SEQ ID NO: 141686 - RNA, 120 nt, Human
ccugcccaccaacucccaggcuuauucaccaaccacuccaccagcucugacccugacuucugggguucccaucucaguccucagccugugcugcugcccccugaagagcauccuuccagg

SEQ ID NO: 141687 - RNA, 110 nt, Human; identical to SEQ ID NO: 140532

SEQ ID NO: 141688 - RNA, 101 nt, Human
cugaguuuccauagggaacuauuggguuuaaagucaccguuggaacuacacugugugaucuuauaaacuuauguucccuggcuaucauauucuuggcucag

SEQ ID NO: 141689 - RNA, 83 nt, Human
ggaucgcuugagcccaggaguucgaggcugcagugagcugugaucacaccacugcacuccagccugggcaacagagcgagacc

SEQ ID NO: 141690 - RNA, 76 nt, Human
ucgcuugagcccaggaguucgaggcugcagugagcugugaucacaccacugcacuccagccugggcaacagagcga

SEQ ID NO: 141691 - RNA, 74 nt, Human
cgcuugagcccaggaguucgaggcugcagugagcugugaucacaccacugcacuccagccugggcaacagagcg

SEQ ID NO: 141692 - RNA, 110 nt, Human; identical to SEQ ID NO: 140532

SEQ ID NO: 141693 - RNA, 98 nt, Human
gaggcaggagaauugcuugaacccaggaagcagagguugcggugagcugaaucaugccacugcacuccagccugggcaacagagcagcacuucgucuc

SEQ ID NO: 141694 - RNA, 87 nt, Human
ggagaauugcuugaacccaggaagcagagguugcggugagcugaaucaugccacugcacuccagccugggcaacagagcagcacuuc

SEQ ID NO: 141695 - RNA, 73 nt, Human
gagaagaguuguucucauggagggccuucagaugagugcuauagacucucuaggcaacuccaagaggcuucuc

SEQ ID NO: 141696 - RNA, 108 nt, Human
caugucugcucaucuguuuauucccaucaucuaacagagugcucaacacauuugcuugaugaauacguuuugagcacugggagaugaucacagaagagcuaagaagug

SEQ ID NO: 141697 - RNA, 92 nt, Human
gcucaucuguuuauucccaucaucuaacagagugcucaacacauuugcuugaugaauacguuuugagcacugggagaugaucacagaagagc

SEQ ID NO: 141698 - RNA, 97 nt, Human
ugcaugcuggguaaaucauucugucucauuugucuguuggaaauacaguucuggcacuaagauauggugaacagacagauggaggccacaacauuca

SEQ ID NO: 141699 - RNA, 89 nt, Human
guucucuauggcuaggcaguaaagaaacagcacccuucauauuuuaagggacugugcuacauuucuucauucuuggcgauuuugagaau

SEQ ID NO: 141700 - RNA, 85 nt, Human
uggugcaugccuguagucucaguuacucuugaggcugaagugaaagacucucuuggguccaggagcuugaggcugcacugagcca

SEQ ID NO: 141701 - RNA, 96 nt, Human
guuuuuacuauaacauauuuuagaaagcuaacaagcuagagagagcggugaagggcucucucagcauguuccucucugucuguguguuaguuuugc

SEQ ID NO: 141702 - RNA, 79 nt, Human
uaacauauuuuagaaagcuaacaagcuagagagagcggugaagggcucucucagcauguuccucucugucuguguguua

SEQ ID NO: 141703 - RNA, 91 nt, Human
guccccuuucucuuucuaccauacccccaguaaagcuacuuaaaauccucuguaggaaagagcugaguaauugggggcagagauggaggac

SEQ ID NO: 141704 - RNA, 82 nt, Human; identical to SEQ ID NO: 140508

SEQ ID NO: 141705 - RNA, 84 nt, Human
aaaauaggacgugucuggaaaaccauaaggcuacuugggauacugucccauuagcauugcuguuuccaugacaaacccuauuuu

SEQ ID NO: 141706 - RNA, 82 nt, Human; identical to SEQ ID NO: 140508

SEQ ID NO: 141707 - RNA, 76 nt, Human
ggucgagguggguguaucgcuugagcccaggaguuugaguccagccugggcaacauagugagaccuugucuugacc

SEQ ID NO: 141708 - RNA, 87 nt, Human
uggguuaccugcaaagauguugcuugguuguauaucuuagaaaaaacucuaaguauuuuaaccagcaacccaacuuugguagccaca

SEQ ID NO: 141709 - RNA, 100 nt, Human
gccuuucuguuuucccuuucugugugguagagacuucacuuaaaucauaaacucaaugucuuuauaucuccucaaccucacuagcacagauccccaaggc

SEQ ID NO: 141710 - RNA, 85 nt, Human
aggaauuugucagaaacucuuuccuguuuugguuuggagaguaguucucucuaacuagagacaggaguggccuugaaauuuuccu

SEQ ID NO: 141711 - RNA, 87 nt, Human
uaccuucuuugcugccugggagaugcugcuaugggcguuuauuugaucugcuuguggcucaguuugcucagcagugaaaugaaggug

SEQ ID NO: 141712 - RNA, 85 nt, Human
accuucuuugcugccugggagaugcugcuaugggcguuuauuugaucugcuuguggcucaguuugcucagcagugaaaugaaggu

SEQ ID NO: 141713 - RNA, 110 nt, Human
cuuacccuguauuucaugcaauacaaaggaagauggcuguuugggguugccgugucucuuagcaauuaaggagauggcuacagccaagcagugugaagugacagcaccag

SEQ ID NO: 141714 - RNA, 98 nt, Human
cuguauuucaugcaauacaaaggaagauggcuguuugggguugccgugucucuuagcaauuaaggagauggcuacagccaagcagugugaagugacag

SEQ ID NO: 141715 - RNA, 112 nt, Human
uggcucacaaagggcuucccugguuauuuacuucugacucuugaaagcuuaaagaaauugugccugagagguucaguaccuuguccagggacacccaguuugugcagagccg

SEQ ID NO: 141716 - RNA, 110 nt, Human
ggcucacaaagggcuucccugguuauuuacuucugacucuugaaagcuuaaagaaauugugccugagagguucaguaccuuguccagggacacccaguuugugcagagcc

SEQ ID NO: 141717 - RNA, 104 nt, Human
cucacaaagggcuucccugguuauuuacuucugacucuugaaagcuuaaagaaauugugccugagagguucaguaccuuguccagggacacccaguuugugcag

SEQ ID NO: 141718 - RNA, 99 nt, Human
cacaaagggcuucccugguuauuuacuucugacucuugaaagcuuaaagaaauugugccugagagguucaguaccuuguccagggacacccaguuugug

SEQ ID NO: 141719 - RNA, 82 nt, Human; identical to SEQ ID NO: 140508

SEQ ID NO: 141720 - RNA, 97 nt, Human
ugccucucuggcacuuccaaucuccuaccugugauagacgucuaagugaaaguacuagcuuaguuguuugggauugguagugacagagaaaacagca

SEQ ID NO: 141721 - RNA, 85 nt, Human
ucucuggcacuuccaaucuccuaccugugauagacgucuaagugaaaguacuagcuuaguuguuugggauugguagugacagaga

SEQ ID NO: 141722 - RNA, 83 nt, Human
cucuggcacuuccaaucuccuaccugugauagacgucuaagugaaaguacuagcuuaguuguuugggauugguagugacagag

SEQ ID NO: 141723 - RNA, 100 nt, Human
cuaugcccagcauuggaaagaguagaggcccuuacuagcacaccucaaaucaaacugggguugcagcagaccuuuugccuucuuuagaggcuggaaauag

SEQ ID NO: 141724 - RNA, 95 nt, Human
acuagucagaaaggauaauggagaaggcaucuguguccccuguuaccuguaguaacagcguauagucugucucucucccuaucucaucuccuagu

SEQ ID NO: 141725 - RNA, 77 nt, Human
ucugauccuggaacugcauugcuugguggucaggagggguucuuaguaagcaaacucaguuuaaucccagagucgga

SEQ ID NO: 141726 - RNA, 108 nt, Human
gcgaucucuuaacaauuuccgggcugaacagccucaccagcaugccauguacuaccuccgcuugcugaugacugaaguggccuggacuaaagaugaguuaaaagaagc

SEQ ID NO: 141727 - RNA, 101 nt, Human
ucucuuaacaauuuccgggcugaacagccucaccagcaugccauguacuaccuccgcuugcugaugacugaaguggccuggacuaaagaugaguuaaaaga

SEQ ID NO: 141728 - RNA, 74 nt, Human
ggacaccaugauauguaaugcggggucuggagguuggaaugccuccauaaaacaccugccauauuuuuuggucc

SEQ ID NO: 141729 - RNA, 72 nt, Human
cgcuugagcccaggaggcagagguugcagugagccaagauggcaccacugcacuccagccugggcaacagug

SEQ ID NO: 141730 - RNA, 103 nt, Human
gagacucacccguucuacuggcaacuggaguuuguucaagaaauaccugaguugguucuuuaacugucgaguucgauuguccaaguggaagggugggagucuc

SEQ ID NO: 141731 - RNA, 93 nt, Human
cucacccguucuacuggcaacuggaguuuguucaagaaauaccugaguugguucuuuaacugucgaguucgauuguccaaguggaaggguggg

SEQ ID NO: 141732 - RNA, 91 nt, Human
guagcugcugguaaggggcccagacuuggagaugggggccuggaguucuauucuaccuccauucacagcuggcugagagacuagcggucac

SEQ ID NO: 141733 - RNA, 108 nt, Human
ccuggaggccuuuccauauuagauauguccccuucuauaagugcaauacacuuaaugguucccucugugcuuagggagggaaguaaucuaagcagaagguuuuuaagg

SEQ ID NO: 141734 - RNA, 81 nt, Human
cacggcuauuaaguagcagaacugggcuugaauucagaucugcuucucaguccaguguucucugcucuguaacuggcugug

SEQ ID NO: 141735 - RNA, 100 nt, Human
aggugauggaugggcaugcagugaggucacuguuggaugucagacuggagcccgaccucagugacucucaccagggccucagacugugagccuggcaccu

SEQ ID NO: 141736 - RNA, 113 nt, Human
cuugcccaugcucuguuagggucucaacaggaagcagaugacauaauuccaaauaggguaauuugaggaagguuauuugcaaugagacuauuuacaacgguguuggggguagg

SEQ ID NO: 141737 - RNA, 101 nt, Human
ugaggcaggagaaucacuugaacccaggaagaggagguugcaguaagccgagaucgugccacugcacuccagccugggcaacaaagugagauucccucuca

SEQ ID NO: 141738 - RNA, 88 nt, Human
ggagaaucacuugaacccaggaagaggagguugcaguaagccgagaucgugccacugcacuccagccugggcaacaaagugagauucc

SEQ ID NO: 141739 - RNA, 82 nt, Human
gggguauaggcacugagaagcaaacaggauucaucugagaacaucgguugcaugucucugugcuucaguguucaagucuccc

SEQ ID NO: 141740 - RNA, 88 nt, Human
gguccuacuuccaagcuccaggaacuuacauuccuucaucaagaggguuuuagaacgacuggaaaaugucuagcauggugaguaggcu

SEQ ID NO: 141741 - RNA, 125 nt, Human
ugcuguggccuaacaguuguuuucugaguauauuuucaugucaaauagcaaaaguagaacuuuuggaggaggugugaagaaaugaagagugacuagaggaaaauagagagucagaaguugcagua

SEQ ID NO: 141742 - RNA, 91 nt, Human
ccuaacaguuguuuucugaguauauuuucaugucaaauagcaaaaguagaacuuuuggaggaggugugaagaaaugaagagugacuagagg

SEQ ID NO: 141743 - RNA, 77 nt, Human
cccccuccugcugcacucacaacagcuuccccucuccuguuuagagguggaagcauguaagaaugcguuugaggggg

SEQ ID NO: 141744 - RNA, 103 nt, Human
cccgccucagccucucgagucacugggauuacagaugugagccaccaugcccaguuggaugcucuaaacauuaaauucuaagcaaagagaugaugaggcuggg

SEQ ID NO: 141745 - RNA, 102 nt, Human
cccgccucagccucucgagucacugggauuacagaugugagccaccaugcccaguuggaugcucuaaacauuaaauucuaagcaaagagaugaugaggcugg

SEQ ID NO: 141746 - RNA, 91 nt, Human
ucauagucugcguuuguuugugcccaucuuuuuugggaagucuuuccagguauucacagagacuugggccucaaacugaaugaugcugugg

SEQ ID NO: 141747 - RNA, 91 nt, Human
cugcaucaccugugagaggaaagaaccuuguuuuuauagcagagaaauauaagcacagggagguucugucacuugccagugaugaucccag

SEQ ID NO: 141748 - RNA, 82 nt, Human; identical to SEQ ID NO: 140508

SEQ ID NO: 141749 - RNA, 97 nt, Human
gugugucugguuuccaggaggcaggcgugcugucugaagaggcuuuggaaguaccccaaauaauucaguucuugaccugccccagggccacacacau

SEQ ID NO: 141750 - RNA, 93 nt, Human
gugucugguuuccaggaggcaggcgugcugucugaagaggcuuuggaaguaccccaaauaauucaguucuugaccugccccagggccacacac

SEQ ID NO: 141751 - RNA, 91 nt, Human
caguaagaugaaauaaaaagcucaugcucuuuucugcuggacuuuaaccuggguaagcgcaugucaagagcuuuuuguuguuguuuugcug

SEQ ID NO: 141752 - RNA, 100 nt, Human
gaaagggaguccacggaagcgugagaauggaggaagaacagugcuuugagugacugcugcagggucuuccuauuauuuuuaguucugaggauucucguuc

SEQ ID NO: 141753 - RNA, 92 nt, Human
gggaguccacggaagcgugagaauggaggaagaacagugcuuugagugacugcugcagggucuuccuauuauuuuuaguucugaggauucuc

SEQ ID NO: 141754 - RNA, 82 nt, Human
ggccaugccuuugucacccuaaauacugcacggccaugccuuugucaggcaggcugagugacugggaguuaggaggguggcc

SEQ ID NO: 141755 - RNA, 92 nt, Human
ugagaauugcuugaacccaggaggcagagguugcagugagccgagaucgugccacugcacuccauccugagugacaaagcaagacugucuca

SEQ ID NO: 141756 - RNA, 76 nt, Human
uugcuugaacccaggaggcagagguugcagugagccgagaucgugccacugcacuccauccugagugacaaagcaa

SEQ ID NO: 141757 - RNA, 82 nt, Human; identical to SEQ ID NO: 140508

SEQ ID NO: 141758 - RNA, 82 nt, Human; identical to SEQ ID NO: 140508

SEQ ID NO: 141759 - RNA, 87 nt, Human
ggagaauugcuugaacccgggagguggagguugcagugagccgagaucgcccacugcacuccagccugggcaacagagcaagacucu

SEQ ID NO: 141760 - RNA, 75 nt, Human
uugcuugaacccgggagguggagguugcagugagccgagaucgcccacugcacuccagccugggcaacagagcaa

SEQ ID NO: 141761 - RNA, 72 nt, Human
uuaugaauccguuuuuaugaaauguccaaaauaggcaaaucuauggacagaaaguagaaagcagauucgugg

SEQ ID NO: 141762 - RNA, 68 nt, Human
augaauccguuuuuaugaaauguccaaaauaggcaaaucuauggacagaaaguagaaagcagauucgu

SEQ ID NO: 141763 - RNA, 78 nt, Human
acacuguguuagcacccugugauauuauucauaauauccaugauauuacuacugacauccagggugauaaugcagugu

SEQ ID NO: 141764 - RNA, 78 nt, Human
ucccugaauucccagaagagcaugcucaagacaccuccaaggaggagugugugagaugucuacugagaguauaaggga

SEQ ID NO: 141765 - RNA, 99 nt, Human
gaguguuacauaagcuaggcaugguaacacacgccuguagucccggcuugagaccaggagguugaggcugcggugaguuaccaucaugccacugcacuc

SEQ ID NO: 141766 - RNA, 82 nt, Human; identical to SEQ ID NO: 140508

SEQ ID NO: 141767 - RNA, 100 nt, Human
gaggcaggagaaucgcuugaacccgggaggcggagguuguggugagccaagauugcgccauugcacuccagccugggcaacaacagcgaaacucugucuc

SEQ ID NO: 141768 - RNA, 96 nt, Human
ggcaggagaaucgcuugaacccgggaggcggagguuguggugagccaagauugcgccauugcacuccagccugggcaacaacagcgaaacucuguc

SEQ ID NO: 141769 - RNA, 89 nt, Human
ggagaaucgcuugaacccgggaggcggagguuguggugagccaagauugcgccauugcacuccagccugggcaacaacagcgaaacucu

SEQ ID NO: 141770 - RNA, 88 nt, Human
ggagaaucgcuugaacccggcaggcagaaguugcagugagccgagaucacgccauugcacuucagccugggugacagagggggacucc

SEQ ID NO: 141771 - RNA, 76 nt, Human
ugguccacauucuacauaguagcacccuccacacaguggacaaugucaagagguggcacugugugggguggggcca

SEQ ID NO: 141772 - RNA, 105 nt, Human
acggaaccugaugaacuaauucuguacucagaaauuacugacggcauuuuacuugagagacaugcgugucagccauuucugccacggggguucuucugaugcugu

SEQ ID NO: 141773 - RNA, 103 nt, Human
gcaggcagggagagggaggaggugaaggaacaaaugcugaacaccuguuauuuaugaagcacucuacauauguucuuucauuucacuccuggugaaaaccugc

SEQ ID NO: 141774 - RNA, 99 nt, Human
gcagggagagggaggaggugaaggaacaaaugcugaacaccuguuauuuaugaagcacucuacauauguucuuucauuucacuccuggugaaaaccugc

SEQ ID NO: 141775 - RNA, 77 nt, Human
gggaggaggugaaggaacaaaugcugaacaccuguuauuuaugaagcacucuacauauguucuuucauuucacuccu

SEQ ID NO: 141776 - RNA, 66 nt, Human
aacguguggugauugaugcuuucauggacucuguugccccaaguccccaagccuuguaccagcguu

SEQ ID NO: 141777 - RNA, 81 nt, Human
ggagaaucgcuugaaucagggaguuggagguugcagugagcugaggucaccugcauuccagccugcugacagcgagacucc

SEQ ID NO: 141778 - RNA, 103 nt, Human
ucggucagcuuccccacuaggcugugaguuacugaauggcgaagagugugucuuauucacaucuggauucuaguaguuagccuaguaccugguaagugagcga

SEQ ID NO: 141779 - RNA, 80 nt, Human
ggucauggccuggaguugcugauaauuuaggugggauagauacuuggucuacuuaagcucaauguaacccagagcccacc

SEQ ID NO: 141780 - RNA, 89 nt, Human
ggagaaucgcuugaacccgggagccggagguugcagugagucgagaucaugccacugcacuccagccugggcaacaagagugagacucc

SEQ ID NO: 141781 - RNA, 82 nt, Human
ugguaccugaaaagaaguugcccauguuauuuucgcuuuauaugugacgaaacaaacauggugcacuucuuuuucgguauca

SEQ ID NO: 141782 - RNA, 131 nt, Human
ucaugguuccuggaagguaagauugguggccaccacauucagucuccuucacagcuaaguguagccacauaacuaugcuuuggccacggggauaugaaugcuacuacuaauuuuuucccuugaaacaaugg

SEQ ID NO: 141783 - RNA, 103 nt, Human
gguaagauugguggccaccacauucagucuccuucacagcuaaguguagccacauaacuaugcuuuggccacggggauaugaaugcuacuacuaauuuuuucc

SEQ ID NO: 141784 - RNA, 96 nt, Human
aagauugguggccaccacauucagucuccuucacagcuaaguguagccacauaacuaugcuuuggccacggggauaugaaugcuacuacuaauuuu

SEQ ID NO: 141785 - RNA, 81 nt, Human
aagaagaaagaaagcuggcuagggaccucaggaucucaagaacaucauggaauugaguucccuggguuuucuuuuugccuu

SEQ ID NO: 141786 - RNA, 82 nt, Human; identical to SEQ ID NO: 140508

SEQ ID NO: 141787 - RNA, 102 nt, Human
ugaggcaggagaaucauuugaacccaggagguggaaguugcagugagcucagaucgcaccauugcacuccagccuggguaacaagaaugaaacuccaucuca

SEQ ID NO: 141788 - RNA, 76 nt, Human
cuuugugaagguuaaggugucacuuagccucuccgagucacgguaaaauggaacaauggcaccugcccucacagag

SEQ ID NO: 141789 - RNA, 82 nt, Human; identical to SEQ ID NO: 140508

SEQ ID NO: 141790 - RNA, 88 nt, Human
guggacuuaggagguagagagugcuuuggguguaggccagguaaguuucuggucugccugcauuaggcacuugguagcuguuagcuau

SEQ ID NO: 141791 - RNA, 74 nt, Human
guucauuggcaccauaucugucaguggaaacauaucucuuguuucuccugaggagaauggaugucuucaugagc

SEQ ID NO: 141792 - RNA, 82 nt, Human; identical to SEQ ID NO: 140508

SEQ ID NO: 141793 - RNA, 99 nt, Human
gaggcaggaggaucgcuugaacccgggaggcagagguugcagugagccaagauugcgccacugcacuccagccugggcaacagagugagacucugucuc

SEQ ID NO: 141794 - RNA, 95 nt, Human
aguacaaugauucaguggccagaacaggagcaguuauuagcacuagcacgcauggcuaauaccacugcuucuccucuggcucuuguagugguauu

SEQ ID NO: 141795 - RNA, 86 nt, Human
augauucaguggccagaacaggagcaguuauuagcacuagcacgcauggcuaauaccacugcuucuccucuggcucuuguaguggu

SEQ ID NO: 141796 - RNA, 73 nt, Human
caguggccagaacaggagcaguuauuagcacuagcacgcauggcuaauaccacugcuucuccucuggcucuug

SEQ ID NO: 141797 - RNA, 113 nt, Human
gugacuccugauaugaaauccauugccaaggcugaccuuaucgucacuacgccagagaagugggauggagucagcagaagcuggcaaaauaggaacuauguucagcaagucac

SEQ ID NO: 141798 - RNA, 83 nt, Human
ucauuugcuauuagacaucuuguggcuugacauccucgaaggcucagccaccccuggguguguuugguuaauacagcaaguga

SEQ ID NO: 141799 - RNA, 108 nt, Human
aaagggggguguaguuauaaccagggucaucuuugaucucauuuggaaaacuucauuucaagauggaguugcaggugguccuuggggacugauucugcaagccccuuu

SEQ ID NO: 141800 - RNA, 82 nt, Human; identical to SEQ ID NO: 140508

SEQ ID NO: 141801 - RNA, 105 nt, Human; identical to SEQ ID NO: 141609

SEQ ID NO: 141802 - RNA, 98 nt, Human
gaggcgaagaauugcuugaacccaggagguggagguugcagugagccaagaucaugccacugcacuccagccugggcaacagagcaagacucugucuc

SEQ ID NO: 141803 - RNA, 78 nt, Human
uaggguagugcaaaaguaauugaggguuuugccauuuaaaguaauggcaagagcugcgauuacuuuugcaccaaccug

SEQ ID NO: 141804 - RNA, 102 nt, Human
agugcuuaccuguauuuuuucucaauaaucuuagaggucucugccuuacaggugagauaacugaaucauugagauuaaguaguucacacgguguauagugcu

SEQ ID NO: 141805 - RNA, 102 nt, Human
gucagccagcccacauuuuaugacaauuggaagaguagauguuacggacgccagguuaaauccaucuacacuucgaguugucuuuuacaggcuacugcugac

SEQ ID NO: 141806 - RNA, 113 nt, Human
gggaggcugagggggaggaucacuugagcccaggaguucaaggcugcagugagccaugauugcgccacugcacuccagccugggcaacagagcaagacccugccccgccgccu

SEQ ID NO: 141807 - RNA, 108 nt, Human
ggcugagggggaggaucacuugagcccaggaguucaaggcugcagugagccaugauugcgccacugcacuccagccugggcaacagagcaagacccugccccgccgcc

SEQ ID NO: 141808 - RNA, 96 nt, Human
gggggaggaucacuugagcccaggaguucaaggcugcagugagccaugauugcgccacugcacuccagccugggcaacagagcaagacccugcccc

SEQ ID NO: 141809 - RNA, 74 nt, Human
gcccuucagucucaguagccacauuucaagugcucaauaguuacaugugcccaguggcugcuggacuggguggu

SEQ ID NO: 141810 - RNA, 72 nt, Human
cccuucagucucaguagccacauuucaagugcucaauaguuacaugugcccaguggcugcuggacugggugg

SEQ ID NO: 141811 - RNA, 105 nt, Human; identical to SEQ ID NO: 141609

SEQ ID NO: 141812 - RNA, 81 nt, Human
ucaguucuguuuaucugaaggcuccuacccagagauucuacccagugaaacucccacagcagcgcagguagauggggcuga

SEQ ID NO: 141813 - RNA, 105 nt, Human; identical to SEQ ID NO: 141609

SEQ ID NO: 141814 - RNA, 106 nt, Human
aaaauaaaauagaaaucauuauugucuaggcuuuuggagaagcauaugcugugaaaaugaucacggcugugcuccuaaaagccagucauguuucuguaacaguuuu

SEQ ID NO: 141815 - RNA, 89 nt, Human
auagaaaucauuauugucuaggcuuuuggagaagcauaugcugugaaaaugaucacggcugugcuccuaaaagccagucauguuucugu

SEQ ID NO: 141816 - RNA, 78 nt, Human
cauguuuauggccuaggauaaugggcuaccauacagccuagguguaugguaggcuguaucaucuagguuugcacaaug

SEQ ID NO: 141817 - RNA, 112 nt, Human
cugugaugguuguguucuauuauaaaguggcaccauuggagucuaagggugcuuguuugcccuuacacuaaauggucccaaguguuuaugugguucugacacugccguccag

SEQ ID NO: 141818 - RNA, 102 nt, Human
cacuucauauaccagaagcaccucagcccugaggucuuggggacauagauagguucuucaucucacgugauggggacugagcucuuuuugguggguaaagug

SEQ ID NO: 141819 - RNA, 82 nt, Human; identical to SEQ ID NO: 140508

SEQ ID NO: 141820 - RNA, 99 nt, Human
cuagggugcacaguuuuuaagaaggcucgcucucucagggggaccaucccgcacuugcaugcccuugagaaugagguccuccuuaaauauucacucugg

SEQ ID NO: 141821 - RNA, 90 nt, Human
gaggggcuuaagcuacuacuuucaggcugugcugagugauauacauacaaugccucauugacaauccugaaggaugguauuuugcuucuc

SEQ ID NO: 141822 - RNA, 79 nt, Human
gcauugcuugaguccaggaggucaaggcugcagugagucaaggucaugccacugcacuccauccugggacagagcaagc

SEQ ID NO: 141823 - RNA, 111 nt, Human
ccaggccugccgguagguuuagaaugaggucugugucacugugguauuacgauauuuugacugguuauuauaaccacagugucacagaguccaucaaaaacccaugccugg

SEQ ID NO: 141824 - RNA, 97 nt, Human
gguagguuuagaaugaggucugugucacugugguauuacgauauuuugacugguuauuauaaccacagugucacagaguccaucaaaaacccaugcc

SEQ ID NO: 141825 - RNA, 104 nt, Human
ugugaugacacagcaagaagguccucgccagaugcuccuggacuugcuuuggacuuucccuugcucuuggacuugcucuggcaccugugcucuuggacuucaca

SEQ ID NO: 141826 - RNA, 101 nt, Human
gggacagcauccuuuuuuggcauuuguuuguugcggguggggagaggauugaacccuuaaccucaccucgcucgcaaguaucaagaaagggaaccugaccc

SEQ ID NO: 141827 - RNA, 98 nt, Human
uccccuuccucuuucccucccaguuguaaauaacauuuuuuagcagcaauguaaucugcuaaauguuaguuguuuagggaaguccugagaaaagggga

SEQ ID NO: 141828 - RNA, 77 nt, Human
cccuggaggcaggugcagauggaggcuguuuccugucaggaugugggacuuugucuucuucugacaguuccccaggg

SEQ ID NO: 141829 - RNA, 77 nt, Human; identical to SEQ ID NO: 141828

SEQ ID NO: 141830 - RNA, 90 nt, Human
gggaugccaaacccucucccuguguuacauuagugcuaugacugaacauaaacacugcuguaauggacggugagaucuucgugucauccu

SEQ ID NO: 141831 - RNA, 73 nt, Human
cucuugaacccaggagguggagguuggggugagcugagaucacuccauugcacuccagucugggcaacgagag

SEQ ID NO: 141832 - RNA, 99 nt, Human
gagcugccagcauggcuagaaugaagcagguaggagaaauuggagagacuagacuuguugagucuuccagccuccaucuuucucccaugcuggaugcuu

SEQ ID NO: 141833 - RNA, 94 nt, Human
ggaaucuugcuuuguagcccaggcuggagugcaguggugugaucuuggcucacggcaaccucugccucccgggucuaggcucaagcaguucucc

SEQ ID NO: 141834 - RNA, 92 nt, Human
ggaaucuugcuuuguagcccaggcuggagugcaguggugugaucuuggcucacggcaaccucugccucccgggucuaggcucaagcaguucu

SEQ ID NO: 141835 - RNA, 108 nt, Human
uccucuccacgcuuuacuuuuagguaacugcuuuuguugugcagggacugguguaccacagcacaccuccucccgccuggaguaaagcagcugaccgcgugaagggga

SEQ ID NO: 141836 - RNA, 89 nt, Human
ggagaaucgcuugaaccugagaggcggagguugcggggagccaagaucgcaccauugcacuccagccugggcaacaagagcgaaacucc

SEQ ID NO: 141837 - RNA, 113 nt, Human
aguuugcaucugugcaauauuauuaugaaggucuuuaguggcagagucuaggucuuuuccuuacucuguaauucugaagcaccuggaguacuaucaggcaugugcuuguuacu

SEQ ID NO: 141838 - RNA, 71 nt, Human
ugggaguuuucuaacacauggucugaucaagucaaugcuaacgggcugcauugcuugguugagagcuucca

SEQ ID NO: 141839 - RNA, 99 nt, Human
uccuacaacuugagucuuugauacuggugucacuuucaggagcucuaagaauacgucaacucucgcuucugaguuggugaccccucaaccaagaaagga

SEQ ID NO: 141840 - RNA, 96 nt, Human
gggagcaaguuuaggggucagguagugcuccucuuuuccccugaaaucacacaagaaugaggagggcuuucccugacuuugcaaagacucccuccc

SEQ ID NO: 141841 - RNA, 103 nt, Human
ugagguaggagaaucgcuugaacucgggaggggaggcugcagugagccaagaucacacaccacugcacuccagccugggcaacaaagugagacccccaucuca

SEQ ID NO: 141842 - RNA, 87 nt, Human
ggagaaucgcuugaacucgggaggggaggcugcagugagccaagaucacacaccacugcacuccagccugggcaacaaagugagacc

SEQ ID NO: 141843 - RNA, 77 nt, Human
ucgcuugaacucgggaggggaggcugcagugagccaagaucacacaccacugcacuccagccugggcaacaaaguga

SEQ ID NO: 141844 - RNA, 101 nt, Human
cauaaugaguccacagccucgggggacgauuguuccuguuucuguagaauugauuugaaacuugaauaaugucccacugggaggcaaggugaucauaaaug

SEQ ID NO: 141845 - RNA, 92 nt, Human
augaguccacagccucgggggacgauuguuccuguuucuguagaauugauuugaaacuugaauaaugucccacugggaggcaaggugaucau

SEQ ID NO: 141846 - RNA, 108 nt, Human
ccaugcuaaauaaaggagagcuuagguagacagacuugaccuuggagaggccagagaagccuucucugaggacagaaaguuugugcugaagucugaaguguaaguagg

SEQ ID NO: 141847 - RNA, 78 nt, Human
agagcuuagguagacagacuugaccuuggagaggccagagaagccuucucugaggacagaaaguuugugcugaagucu

SEQ ID NO: 141848 - RNA, 111 nt, Human
uaguuuuuaccuuguagacccccugaaauggucuucggcaucuguaguggucccagaccauaccuugaaaacuacugcauuuuacgaagaagauuguuucgguaaugacug

SEQ ID NO: 141849 - RNA, 89 nt, Human
ggagaauugcuugaacccaggacguggagguugccaugagcugagaucacgccauugcacuccagccugggcaacaagagcgaaacucc

SEQ ID NO: 141850 - RNA, 73 nt, Human
cacuugaaccuggaaggcagggguugcagugagcugagauugugccauugcacuccagccugggcaacaagug

SEQ ID NO: 141851 - RNA, 103 nt, Human; identical to SEQ ID NO: 141841

SEQ ID NO: 141852 - RNA, 87 nt, Human; identical to SEQ ID NO: 141842

SEQ ID NO: 141853 - RNA, 77 nt, Human; identical to SEQ ID NO: 141843

SEQ ID NO: 141854 - RNA, 97 nt, Human
ggaaggccauguuagacggcaaaaugguuuucuagaacaugaaauggaauauacauugcccucauuucuauaaaccaggacucuaacaagggcuucc

SEQ ID NO: 141855 - RNA, 103 nt, Human
ugagguaggagaaucacuugaacucgggaggggaggcugcagugagccaagaucacacaccacugcacuccagccugggcaacaaagugagacccccaucuca

SEQ ID NO: 141856 - RNA, 87 nt, Human
ggagaaucacuugaacucgggaggggaggcugcagugagccaagaucacacaccacugcacuccagccugggcaacaaagugagacc

SEQ ID NO: 141857 - RNA, 88 nt, Human
ggagaaucacuugaacucgggaggggaggcugcagugagccaagaucacacaccacugcacuccagccugggcaacaaagugagaccc

SEQ ID NO: 141858 - RNA, 77 nt, Human
ucacuugaacucgggaggggaggcugcagugagccaagaucacacaccacugcacuccagccugggcaacaaaguga

SEQ ID NO: 141859 - RNA, 107 nt, Human
ucagucccuuugggugugacugcuguacacauuuucauguuaccauugacaucuucaguuuuucaaugugauguguaaugcauauaagcagcauauguagugguuga

SEQ ID NO: 141860 - RNA, 92 nt, Human
ggaguauccuggggaucaguucaaaugcagauucaggaguucuggggccaggccugagacucugcauuuauagcaagcccccaggugacgcc

SEQ ID NO: 141861 - RNA, 103 nt, Human
cugaggcaggagaauugcuuguacccgggaggugaagguugcagugagccgagauggugccacugcacuccagccugggcaacagagcaaggcccuguuucag

SEQ ID NO: 141862 - RNA, 106 nt, Human
uuggaauagggucccgucccgauaaauucauuguaagaugaagauacuauaaguugaaagugcguuuucaauuuaugauggguuuaucuggauguaaccccaccaa

SEQ ID NO: 141863 - RNA, 82 nt, Human; identical to SEQ ID NO: 140508

SEQ ID NO: 141864 - RNA, 84 nt, Human
uuaggaaaguaguuuuaaucucauaggcccccaguggggauccccugggauccucuggccaugcugugagaacugcuagccuag

SEQ ID NO: 141865 - RNA, 103 nt, Human; identical to SEQ ID NO: 141841

SEQ ID NO: 141866 - RNA, 87 nt, Human; identical to SEQ ID NO: 141842

SEQ ID NO: 141867 - RNA, 77 nt, Human; identical to SEQ ID NO: 141843

SEQ ID NO: 141868 - RNA, 122 nt, Human
uccugaaagugaauugagauuaaucaauugucaugaucugaccaugguuauucagaaacuuugaauaaguucaugagaagaucauucugaucugaauacagguuucaagaaacucaacugga

SEQ ID NO: 141869 - RNA, 101 nt, Human
ugaggcacgagaaucgcuugaacccaggaggcggaggcugcagugagcagagaucacgccacugcacuccagccugggcaacagagggagacucugucuca

SEQ ID NO: 141870 - RNA, 94 nt, Human
cauguuggccagacuggucuguaacuccagacuucaggugaucugcccaccuuggccucccaaagugcugggauuacaggccugagccaccaug

SEQ ID NO: 141871 - RNA, 103 nt, Human; identical to SEQ ID NO: 141841

SEQ ID NO: 141872 - RNA, 87 nt, Human; identical to SEQ ID NO: 141842

SEQ ID NO: 141873 - RNA, 77 nt, Human; identical to SEQ ID NO: 141843

SEQ ID NO: 141874 - RNA, 100 nt, Human
cucugucacccaggcuggagugagugugaucuuggcucacggcaaccuuugccuccuggguucaagcaauucuccugcccuagccucccgaguagcagag

SEQ ID NO: 141875 - RNA, 111 nt, Human
uucagguuuucagacaccugcaguaguagaacagaauauuuuagcucugaggacaaucuaaguuaugaauagucugguucuguaaggauuugcauaguuuggagaaaugaa

SEQ ID NO: 141876 - RNA, 113 nt, Human
ggcccagcguggcuccugaccuggaggauaacaaugauaauggaagugcuguuaaaaguaagaaugacuaugaguuauugaguuuuucaucugcucaggcaccgugcugggcc

SEQ ID NO: 141877 - RNA, 98 nt, Human
ucuucauuauccucuauaucauugcuaugcccugguguugugcccgggguacaacacguaguagguguucgauaaacuuggguuggauaaauggaaga

SEQ ID NO: 141878 - RNA, 79 nt, Human
gagucuaguuacuaggcaguguaguuagcugauugcuaauaguaccaaucacuaaccacacggccagguaaaaagauuu

SEQ ID NO: 141879 - RNA, 63 nt, Human
uuacuaggcaguguaguuagcugauugcuaauaguaccaaucacuaaccacacggccagguaa

SEQ ID NO: 141880 - RNA, 83 nt, Human
ggauggcuugaguccaggagguggagguugcagugaacagagauugugucacugcacucuagccugggcaacagagcgagacc

SEQ ID NO: 141881 - RNA, 72 nt, Human
gcuugaguccaggagguggagguugcagugaacagagauugugucacugcacucuagccugggcaacagagc

SEQ ID NO: 141882 - RNA, 82 nt, Human; identical to SEQ ID NO: 140508

SEQ ID NO: 141883 - RNA, 125 nt, Human
uuaaaaauugcugaugccugggucccacccuuaaaaaugcugauuuaauuggucuggaguagugcucgcuucggcagcacauaugcuaauuggucuggaguaugcccgagcauuagguuuuuuga

SEQ ID NO: 141884 - RNA, 96 nt, Human
gagacaggagaaucgcuugaaccugggaggcagagguugcgguuagccaagauugugccacugcacuccaugggugacacagagagacucugucuc

SEQ ID NO: 141885 - RNA, 95 nt, Human
cuagagucccccucagcugugggggagcuuucaaauuugaaaucaggagacucgaauuccaguuuuuccuaccccuuagugcugugggacuuuag

SEQ ID NO: 141886 - RNA, 121 nt, Human
gugauucagccagacgugauggaggaaauggugguaucuuguguuauuaagcacuugaacuugguugaugcacugcagucucuaauaaauuuccaauaucaagaagaacaugcugaagaau

SEQ ID NO: 141887 - RNA, 113 nt, Human
uucagccagacgugauggaggaaauggugguaucuuguguuauuaagcacuugaacuugguugaugcacugcagucucuaauaaauuuccaauaucaagaagaacaugcugaa

SEQ ID NO: 141888 - RNA, 111 nt, Human
ucagccagacgugauggaggaaauggugguaucuuguguuauuaagcacuugaacuugguugaugcacugcagucucuaauaaauuuccaauaucaagaagaacaugcuga

SEQ ID NO: 141889 - RNA, 85 nt, Human
ugauggaggaaauggugguaucuuguguuauuaagcacuugaacuugguugaugcacugcagucucuaauaaauuuccaauauca

SEQ ID NO: 141890 - RNA, 97 nt, Human
ucagcgggguccaucaccacaugugcauagcucugggucacuuuaaagaucgcauuaccugagugcucaguguugcuguaaggaaauguccugcuga

SEQ ID NO: 141891 - RNA, 82 nt, Human; identical to SEQ ID NO: 140508

SEQ ID NO: 141892 - RNA, 91 nt, Human
ugggcaccagccaaagcacagcuuauuuuaugccauuaccgcuauuggaauaguacaaaaugugccuacagugggcuguuggaccugcuca

SEQ ID NO: 141893 - RNA, 102 nt, Human
uggagcugcuggguaaaauaauguguacuugucuuaguuugcucuuuuccaaguugaagucuggcagauuucaccagagcacagugucugcccccaccucca

SEQ ID NO: 141894 - RNA, 103 nt, Human; identical to SEQ ID NO: 141841

SEQ ID NO: 141895 - RNA, 87 nt, Human; identical to SEQ ID NO: 141842

SEQ ID NO: 141896 - RNA, 77 nt, Human; identical to SEQ ID NO: 141843

SEQ ID NO: 141897 - RNA, 84 nt, Human
agggguuguccuuaaguucccucugccugcaguccugcuuuguuuuggacaaguaggagugacaagcaggucagcacagcccuu

SEQ ID NO: 141898 - RNA, 82 nt, Human
gggguuguccuuaaguucccucugccugcaguccugcuuuguuuuggacaaguaggagugacaagcaggucagcacagcccu

SEQ ID NO: 141899 - RNA, 80 nt, Human
ggguuguccuuaaguucccucugccugcaguccugcuuuguuuuggacaaguaggagugacaagcaggucagcacagccc

SEQ ID NO: 141900 - RNA, 112 nt, Human
cauggggccccuuugcucauuuuuggacuauuuauacagcagguuuggaucauguuuuucuacuaauaagaaugcuaacauuguuguguagauaaucagugagggcuuuaug

SEQ ID NO: 141901 - RNA, 92 nt, Human
uccugacgggguccucuggcugcauuuaggaacaaggagcuccccgaguaaccugaaguccacucugcccagaggccccacaacuuacagga

SEQ ID NO: 141902 - RNA, 90 nt, Human
ggagaaucacuugaacccgggaaggcggagguugcagugagccgagaucgugccacugcacuccagccugggcaacaagagugagacucc

SEQ ID NO: 141903 - RNA, 78 nt, Human
ucacuugaacccgggaaggcggagguugcagugagccgagaucgugccacugcacuccagccugggcaacaagaguga

SEQ ID NO: 141904 - RNA, 70 nt, Human
cuugaacccgggaaggcggagguugcagugagccgagaucgugccacugcacuccagccugggcaacaag

SEQ ID NO: 141905 - RNA, 82 nt, Human; identical to SEQ ID NO: 140508

SEQ ID NO: 141906 - RNA, 97 nt, Human
ugccugaauaaagcuagacguucauugaccagcagagucuuuuauaacuaccccaguuccguggaaaacuugggcuggucuaaguacuguccaggca

SEQ ID NO: 141907 - RNA, 94 nt, Human
cucugaccugugcucccaaggugaaugaccuuguugggguugacuaagucuuuuccagggaggucaacaucaccucagcuauuucaaaacagag

SEQ ID NO: 141908 - RNA, 82 nt, Human
gggcuuuugcccuagauggacaaguucaaauccuggcucagucacuuaggaaauuuggcuguuugucuugggcaaguugcuc

SEQ ID NO: 141909 - RNA, 102 nt, Human
ugaggcaggagaaucgguugaacccaggaggcagagguuguggugagccgagaucguaccauugcacuccagccugggcaacaagagcaaaacuccgucuca

SEQ ID NO: 141910 - RNA, 100 nt, Human
gaggcaggagaaucgguugaacccaggaggcagagguuguggugagccgagaucguaccauugcacuccagccugggcaacaagagcaaaacuccgucuc

SEQ ID NO: 141911 - RNA, 74 nt, Human
agugcacagcucuuggagucagggcaccuggauaaucugcagacaaaugugccacugcuccaaggcucagcacu

SEQ ID NO: 141912 - RNA, 101 nt, Human
ugaggcaggacaaucacuugaacccaggaguuugaggcugcagugagccgagaucacgccacugcacuccacccugggcaacagagcaagaucuugucucg

SEQ ID NO: 141913 - RNA, 99 nt, Human
gaggcaggacaaucacuugaacccaggaguuugaggcugcagugagccgagaucacgccacugcacuccacccugggcaacagagcaagaucuugucuc

SEQ ID NO: 141914 - RNA, 110 nt, Human
augaagugagucacauuggcuacuggugaggaaggagcagaguugugggcugagacugaugcuguucagcaucugucuuccuugucaccaacauagaugaccacuagcau

SEQ ID NO: 141915 - RNA, 101 nt, Human
agugagucacauuggcuacuggugaggaaggagcagaguugugggcugagacugaugcuguucagcaucugucuuccuugucaccaacauagaugaccacu

SEQ ID NO: 141916 - RNA, 76 nt, Human
ucacuuaaacccgggagguggagguugcagugaguggagauggugccacugcacuccagccugggugacagaguga

SEQ ID NO: 141917 - RNA, 79 nt, Human
ggcaucuguaaucccagcuacucgggaggcugaggcacgagaauugcuugagccugggagguggagauugcagugaguc

SEQ ID NO: 141918 - RNA, 83 nt, Human
ggagaauugcuugaacccaggagguugcagugagccgagguugcgccauugcacuccagccugggcaacaagagcgaaacucc

SEQ ID NO: 141919 - RNA, 92 nt, Human
cgaaggcagcauggaagaauaggcaguauuggauuugaaaucaggagacuuggaauugaauucugccucuuccacuaccagcugugaaauug

SEQ ID NO: 141920 - RNA, 80 nt, Human
gcagcauggaagaauaggcaguauuggauuugaaaucaggagacuuggaauugaauucugccucuuccacuaccagcugu

SEQ ID NO: 141921 - RNA, 82 nt, Human; identical to SEQ ID NO: 140508

SEQ ID NO: 141922 - RNA, 82 nt, Human; identical to SEQ ID NO: 140508

SEQ ID NO: 141923 - RNA, 101 nt, Human
gccugggguuuggaggagguagcuaaguaauacuagagaaauuacaaucuuuaugucuacaaucucagccaguaguugccaggauccacaggaccucaggu

SEQ ID NO: 141924 - RNA, 82 nt, Human
uaccuuggccaaggaacuacuucuccagacaucugccgcuaugcuuugggaaucagaaugggguguaguuucuccaguggua

SEQ ID NO: 141925 - RNA, 85 nt, Human
gaggucauaaugugaauguuguaugcaguggccaugucaucagaacaggugugccagcccccugcauggaacauguacaugcuuc

SEQ ID NO: 141926 - RNA, 128 nt, Human
cugagaggugagauuccacaucccaaguugcacagcuggggagagacagugucaggacaguaucgccugugcugaggucuagcuccccagcuagacugaagcuuuaugaggauuuuauucauuucaag

SEQ ID NO: 141927 - RNA, 82 nt, Human; identical to SEQ ID NO: 140589

SEQ ID NO: 141928 - RNA, 106 nt, Human
gaacugggucauuuaucaaacucuguguuuauguggccuuuagaauauuaucccucaguaaguuagaggcacagauuaauggaguuugaagguugucacuugguuu

SEQ ID NO: 141929 - RNA, 82 nt, Human; identical to SEQ ID NO: 140508

SEQ ID NO: 141930 - RNA, 99 nt, Human
agucagguucuggugagggcccucuucuggguugcagacuguugacuuuuuguacccucacacggcucaaagagggucccuuuaauaaaggcacuaacu

SEQ ID NO: 141931 - RNA, 74 nt, Human
ggcucuacaccucugaaauugcauaccuugaagaagagucaucagaagugugcacaacagagugugguggaguc

SEQ ID NO: 141932 - RNA, 102 nt, Human
ugaggcaggagaaucgcuugaacccaggaggcggagguuguggugagcgaagaucgugccauugcacuccagccugggcaacaagagcaaaacucugucuca

SEQ ID NO: 141933 - RNA, 82 nt, Human; identical to SEQ ID NO: 140508

SEQ ID NO: 141934 - RNA, 78 nt, Human
aaucaaaaagguuugagcaaaggaugaacacaaucuacagucagauuaugucacuccuuugcccagaccuucuugauu

SEQ ID NO: 141935 - RNA, 103 nt, Human
cugagcagggagaaucucgggaucccaggaggucaaggcugcagugagccacaauuuugccacugcacuccagccugggcaacagagcaagacccugucucag

SEQ ID NO: 141936 - RNA, 82 nt, Human; identical to SEQ ID NO: 140508

SEQ ID NO: 141937 - RNA, 82 nt, Human
aaaaaugaaaggaaaaggaggggaggcagaugggaagaugacccuuuuacaaauguuucuucuccuuuuucuuucuguuuuu

SEQ ID NO: 141938 - RNA, 89 nt, Human
ggagaaucgcuugaaccuggggggcggacguugcagugagccaagaucgcaccauugcacuccagccugggcaacaagagcaaaucucc

SEQ ID NO: 141939 - RNA, 110 nt, Human
uaaaagaagguguucuuuuggcucaugcagugugucgaucucugucucucccaagcauuuuuagacuuuaugccagagaccaccuggaggcaaaagacaccauuuauuua

SEQ ID NO: 141940 - RNA, 93 nt, Human
gguguucuuuuggcucaugcagugugucgaucucugucucucccaagcauuuuuagacuuuaugccagagaccaccuggaggcaaaagacacc

SEQ ID NO: 141941 - RNA, 79 nt, Human
ucugagucagugggcugagaaaggcugcccaccuuucaucuaggugggcacaacguaaucagcugccagcuugaccaga

SEQ ID NO: 141942 - RNA, 93 nt, Human
ugagauuucuaaggcacugcuucuaaguaggaaucacacugcaguggguuagugacacccugcucagaaauggugccugugcaaaauguuuca

SEQ ID NO: 141943 - RNA, 113 nt, Human
gguggguuaggagugagaguuacgggaaugagaaugacacaggaacuagcagagauuccaagguaaaagcugggcuguggucauuuugacauuaauucuccccacuaaccacu

SEQ ID NO: 141944 - RNA, 113 nt, Human
acauuauuaggaauuucaagagcugggcauguuggaguaugccugugaucucaguuacuuaggaggcugaggcagaaggauuacuugaggccaggaguuugagucuguagugu

SEQ ID NO: 141945 - RNA, 82 nt, Human
uggaggaggaggcuggugcugguuaaauacaaccuaaaucaaaccacaguugaccaaccaccacauccagcuucuccuucca

SEQ ID NO: 141946 - RNA, 97 nt, Human
gagacaggaccuggcuucaggacuguggacugggcugcuggccugcuugcuuccucccuuccccauuccuagcagggccugaggcccuccucuucuc

SEQ ID NO: 141947 - RNA, 86 nt, Human
aagguagagauucaaacaguggacuggugacaaagcagcugauaaaagcacucucaucuccauccuuugucugggagucucgccuu

SEQ ID NO: 141948 - RNA, 76 nt, Human
uggcaugauacagugacugacaaaugcugaagggcuaaacugcucguaggauuucucaggcuuacugucuuaccca

SEQ ID NO: 141949 - RNA, 80 nt, Human
cacaagccuggcugacuucaccaucuacugauuguauagaccuagugccuucagugaacauaggugguagccaggaagug

SEQ ID NO: 141950 - RNA, 108 nt, Human
cuuuaauagacugauuuuauuuauccucacauucacuucgugagccuuuguuuugguuccaccacugagggaaacugaggcucagggugaucgagucagugguugaag

SEQ ID NO: 141951 - RNA, 82 nt, Human
gggaggccaaggugggaagauugcuugagcccuggagguugagacaagccugggcaacauagcaauaccccauuuguuucuu

SEQ ID NO: 141952 - RNA, 88 nt, Human
ggagaaucacuugaacccaggaggcgaagguugcagugagcuaagaucgcaccacugcacuccagccugggcaacagagugacauucu

SEQ ID NO: 141953 - RNA, 100 nt, Human
cugagcuuagaucuuauguggccuuucuggucuguguaucccaggacuguucaucuccuaugugaugcugaagaccaagagagugaccaagaaggcucag

SEQ ID NO: 141954 - RNA, 113 nt, Human
cccugaacucaggggcuucgccacugauuguccaaacgcaauucuuguacgagucugcggccaaccgagaauuguggcuggacaucuguggcugagcuccgggcgcaacaggg

SEQ ID NO: 141955 - RNA, 105 nt, Human
gcccugaacucaggggcuucgccacugauuguccaaacgcaauucuuguacgagucugcggccaaccgagaauuguggcuggacaucuguggcugagcuccgggc

SEQ ID NO: 141956 - RNA, 96 nt, Human
cucaggggcuucgccacugauuguccaaacgcaauucuuguacgagucugcggccaaccgagaauuguggcuggacaucuguggcugagcuccggg

SEQ ID NO: 141957 - RNA, 89 nt, Human
ggggcuucgccacugauuguccaaacgcaauucuuguacgagucugcggccaaccgagaauuguggcuggacaucuguggcugagcucc

SEQ ID NO: 141958 - RNA, 82 nt, Human; identical to SEQ ID NO: 140508

SEQ ID NO: 141959 - RNA, 105 nt, Human
ccuugagccagucacucagccucucugugccuguuuccuucucuaaaauggggaggauaguaaugauagagaggcccucuugcguguuaaacauacuccuccagg

SEQ ID NO: 141960 - RNA, 89 nt, Human
ucucccuguuucauuccucuugcuucacgauguuacaauaagaaugcauuccuaguuguagaccuaaggagcaguguaaggcagggagg

SEQ ID NO: 141961 - RNA, 95 nt, Human
ccuaggaaagguggugugaaucucaaggacaagugucugggaaggacgguuuuccuuccugcaugcaugccgagaugacuccaggcuuucuuagg

SEQ ID NO: 141962 - RNA, 101 nt, Human
gaugcuaaugaauuucaguuuugguguuggucuaaguagccaaauguauuuuauuugacuauuuggagccaguacucauaaacuguggcagacuuagcauc

SEQ ID NO: 141963 - RNA, 102 nt, Human
cccagugacccacagguaagaaccuuguguuuuccagauucugaguguggcucagcucgugaaugcaguggcacaaggcacucugugggaguggaucuuggg

SEQ ID NO: 141964 - RNA, 81 nt, Human
cccacagguaagaaccuuguguuuuccagauucugaguguggcucagcucgugaaugcaguggcacaaggcacucuguggg

SEQ ID NO: 141965 - RNA, 92 nt, Human
gcagaaaaaggaguugagaagggaguagccucugauauguagucagcaugaaucagccuuagguucccugccuccauacccaauucuucugc

SEQ ID NO: 141966 - RNA, 99 nt, Human
gaggcaggagaauugcuugaacccaggaggcagaaguugcagugagccgagaucgcaucauugcacuccagccugggcaacagagcgagacucugucuc

SEQ ID NO: 141967 - RNA, 97 nt, Human
caggugugcgccaccacacgugacugggaagccuucugguuuuaagauggcuuuagaaugaaaggcaguuccuagcaccuguggucaaucacaucug

SEQ ID NO: 141968 - RNA, 97 nt, Human
ggaacgagaauugcuugaacccaggaggcaaagguugcagugagucaagaucaugccacugcacuccugccugggugacagagugagaccuugucuc

SEQ ID NO: 141969 - RNA, 97 nt, Human
ggucaggguucacagggucaugggucaguagccuuguaaagaacaaguuuuauccuuuuucuccaaggagacugacuuucaccagaagagccccucc

SEQ ID NO: 141970 - RNA, 107 nt, Human
ugacaguuugagaugacacugaggagugugaaagagagccuggaccuucaaagcuugcaaacggcccgggcuauuucuccaccucuucgcuacucaaagcgcuggca

SEQ ID NO: 141971 - RNA, 75 nt, Human
ccugcuguaugcuaggcauugugcaagguguuagggcugaugcuugagcacaguaccuccacaucugcaguaugg

SEQ ID NO: 141972 - RNA, 75 nt, Human
cgcuugcaacugaaaggcggagguugcagugaaccaagaucgcaccacugcacuccagccugggcaacaaaagcg

SEQ ID NO: 141973 - RNA, 111 nt, Human
ggucccugaagucuuauugauuggugcaggucacugauuuuuuuaaugaacuccuguucaauacagaauaugaguggccaucuauugauucaaguucaauuucaagggauc

SEQ ID NO: 141974 - RNA, 106 nt, Human
cacuaggcuagacauacaaagaccccuugcccguggcucccauuucaaauauaucucaugaccagggugugggagcacgacagaggagguaagaguuuaaacugug

SEQ ID NO: 141975 - RNA, 97 nt, Human
cagacugaagucuuuugcuuauuuuggugauaaaagcugaacaugguuugugcugaaguuccagcugguuaucggaguggcugaccaggucagucug

SEQ ID NO: 141976 - RNA, 110 nt, Human
cccuuaugggauucuggaagugguggcuacacggauguacaugagugugaaaaaaucauuaaacuguaugcucugugaagcuuacuguaucuguuauccuuccuaauggg

SEQ ID NO: 141977 - RNA, 112 nt, Human
cagacccucucucuuucccaggcuuccuguccuucagcaaggccaccugagaacugaauuguaaauuccagccuugcaaggaaggggaggaggcugaaagacaagauaaaug

SEQ ID NO: 141978 - RNA, 99 nt, Human
ucucucuuucccaggcuuccuguccuucagcaaggccaccugagaacugaauuguaaauuccagccuugcaaggaaggggaggaggcugaaagacaaga

SEQ ID NO: 141979 - RNA, 90 nt, Human
ucuuucccaggcuuccuguccuucagcaaggccaccugagaacugaauuguaaauuccagccuugcaaggaaggggaggaggcugaaaga

SEQ ID NO: 141980 - RNA, 101 nt, Human
gggauuacaggcaccugcugccaagucuggcuaauuuuuguauuuuuaauagagacgggguuucgcuauguuggccaggcuggucucgaacuccugaucuc

SEQ ID NO: 141981 - RNA, 74 nt, Human
gcuccugcuugcauaugcauggguacacagccuguaacuacaugugugugagccuguggguaugugaggggagu

SEQ ID NO: 141982 - RNA, 86 nt, Human
gaaccuuugauguuacucuaucgucuggaucucuuuugccugugagggaggcagagagguauuuaggcaugaggcagcagagguuu

SEQ ID NO: 141983 - RNA, 72 nt, Human
gguggaaucaaagguaggagagaggcaguagcuucugauuugaauauugccuuucccuauguuugaagcccu

SEQ ID NO: 141984 - RNA, 75 nt, Human
ggaacagcagggcuagaaagccagagagacaggggcucuggcccuuucugaugcuguuuuuagcaccugcuuucc

SEQ ID NO: 141985 - RNA, 83 nt, Human
agcggugaagaccaaggccagagcuuaaacucauaggggucauucaacucuguuuuuauuaguuguccuugguuuauacuguu

SEQ ID NO: 141986 - RNA, 94 nt, Human
ccuccuccauccgucucccagggugccuuuguuuugaaucauuuuugauuucaauuuaagaagagaaagaagaggcugagacgaaggaaggagg

SEQ ID NO: 141987 - RNA, 82 nt, Human; identical to SEQ ID NO: 140508

SEQ ID NO: 141988 - RNA, 95 nt, Human
aggcuggucugaauggcagugggaugucagaacuaauuaaccuuagugucacuauaguuggcauucgacccccacacugcuaaauuugacugccu

SEQ ID NO: 141989 - RNA, 82 nt, Human; identical to SEQ ID NO: 140508

SEQ ID NO: 141990 - RNA, 82 nt, Human; identical to SEQ ID NO: 140508

SEQ ID NO: 141991 - RNA, 113 nt, Human
gccuucuuuguacuagucugucaccuuugcuuggcuuugggaagcuucaaacuagggcaguuuauguuugggagugaccagucaaauagcaagacagacauaggcaaggaugu

SEQ ID NO: 141992 - RNA, 106 nt, Human
ucuuuguacuagucugucaccuuugcuuggcuuugggaagcuucaaacuagggcaguuuauguuugggagugaccagucaaauagcaagacagacauaggcaagga

SEQ ID NO: 141993 - RNA, 84 nt, Human
gucugucaccuuugcuuggcuuugggaagcuucaaacuagggcaguuuauguuugggagugaccagucaaauagcaagacagac

SEQ ID NO: 141994 - RNA, 81 nt, Human
uuccacauagcagcugcuggcaauaaacccacgcggagcaaacuggcguccgagagauuauucgccagugccugcuuggaa

SEQ ID NO: 141995 - RNA, 82 nt, Human; identical to SEQ ID NO: 140589

SEQ ID NO: 141996 - RNA, 87 nt, Human
gggggcucagccauguugaagcauguaugucaaacugauguaagaguuugacagaaauguauuugcaugaauugcugaagagccucc

SEQ ID NO: 141997 - RNA, 99 nt, Human
gaggcaggagaauugcuugaacccaggagguggagguugcagugagcugagaccaugccauugcacuccagccugggcaacagagugagacuugguguc

SEQ ID NO: 141998 - RNA, 86 nt, Human
gagaauugcuugaacccaggagguggagguugcagugagcugagaccaugccauugcacuccagccugggcaacagagugagacuu

SEQ ID NO: 141999 - RNA, 82 nt, Human; identical to SEQ ID NO: 140508

SEQ ID NO: 142000 - RNA, 82 nt, Human; identical to SEQ ID NO: 140508

SEQ ID NO: 142001 - RNA, 88 nt, Human
ggagaaucacuugaaccugggaggcggagguugcagugagccgagauugagccauugcacuccagccuggacaucagggcgagacucc

SEQ ID NO: 142002 - RNA, 88 nt, Human
gcagauagggaaaaaagcuugaugcagagucagggagagcagcucccuuguuccuucacucugcacuuaaguaaucaaccuuaucagc

SEQ ID NO: 142003 - RNA, 104 nt, Human
cccagguuucaguuugguagcaugaauccuuagcauuuagugacuccaguuuuggucugcugucuuucuuaaauggaugcaugaggcaaccauuggguacuggg

SEQ ID NO: 142004 - RNA, 101 nt, Human
ugaggcaggagaaucgcuugaacccagguggcaaggcuugcagugagcugagaucgcacuacugcacuccagccugggcaacagagcgagacuccagcuca

SEQ ID NO: 142005 - RNA, 88 nt, Human
ggagaaucgcuugaacccagguggcaaggcuugcagugagcugagaucgcacuacugcacuccagccugggcaacagagcgagacucc

SEQ ID NO: 142006 - RNA, 94 nt, Human
cccggggagagguacugucuauaggucaggguaaggcagcauaccuggagcuugcagagaaguacccuugagacucagggcagugacuccaggg

SEQ ID NO: 142007 - RNA, 77 nt, Human
uauaaagcaggcagagaaaugugaacuauugagacgggccuggccuccuagucuacaucuuucuccccugcuggaug

SEQ ID NO: 142008 - RNA, 102 nt, Human
ugaggcaggaaaauggcuugaacccgggagguggagguugcagugagcugagauugcgccacugcacuccagccugggcaacaagagcaaaacuccgucuca

SEQ ID NO: 142009 - RNA, 111 nt, Human
accagugguuagcagaugaggugaaagagaugggacagugacuguaucuguucugaugaaggagauugugcaguuacaugcguaacgucauuaaacuucauucuuccaggu

SEQ ID NO: 142010 - RNA, 88 nt, Human
gaugaggugaaagagaugggacagugacuguaucuguucugaugaaggagauugugcaguuacaugcguaacgucauuaaacuucauu

SEQ ID NO: 142011 - RNA, 99 nt, Human
gaggcaggagaguugcuugaacccaggaagcggagguugcagugagcugagauugccucacugcacuccagccugggcaacagagugaaacaaugucuc

SEQ ID NO: 142012 - RNA, 70 nt, Human
cuugaacccaggaagcggagguugcagugagcugagauugccucacugcacuccagccugggcaacagag

SEQ ID NO: 142013 - RNA, 97 nt, Human
aaugagcagaggugggcauugaagcagucguuuuugcuguauucccucuguucagaaguuaaguagaaccacagcucgauguccccucaggcucauu

SEQ ID NO: 142014 - RNA, 97 nt, Human
aggcaggagaauugcuugaaccugugaggcagagguugcagugagcugagaucaugccacagcacuucagccugagcgacagagcgagacuccaccu

SEQ ID NO: 142015 - RNA, 107 nt, Human
gucccaaccacugcauuuaguggaucucgccauguggcucugcucaucuucuuaaguuuuggggguuacauuugggauucuuagaaaugcuuuuucuggcugggcac

SEQ ID NO: 142016 - RNA, 82 nt, Human; identical to SEQ ID NO: 140626

SEQ ID NO: 142017 - RNA, 87 nt, Human
agcugacguuuuucuggggggacugaacugggagacuuugcgacugcauucguacaguacuccuggcagcccugcagaagaggugcu

SEQ ID NO: 142018 - RNA, 77 nt, Human
gggcuaaguagcauuaacagagaugucugaaagggcacuggccuggggcugccugugacaugcucuguuugcggccu

SEQ ID NO: 142019 - RNA, 84 nt, Human
ggggaaagugugaagauuucaaagcccaggguccuucacggagccacacggcucuccuuggcacuuaaucuucaagcucuccuc

SEQ ID NO: 142020 - RNA, 96 nt, Human
uccuugaaaaaccuuucaagugccagaggcagaaaagugggugagaggucuacagguccuaucucuggucaacaugauuuaagcauuuuuuaggga

SEQ ID NO: 142021 - RNA, 106 nt, Human
uccguguacauuuaaucucuuuuucugugccuuauuucgggggcugggacccuucaguccaguguugaagagaggcagccaguggaggucuugucucauucaagga

SEQ ID NO: 142022 - RNA, 82 nt, Human; identical to SEQ ID NO: 140508

SEQ ID NO: 142023 - RNA, 100 nt, Human
uguucagaaagucuguuguuguaaacauccccgacuggaagcuguaagacacagcuaagcuuucagucagauguuugcugcuaccggcuauucacagaca

SEQ ID NO: 142024 - RNA, 87 nt, Human
gaaagucuguuguuguaaacauccccgacuggaagcuguaagacacagcuaagcuuucagucagauguuugcugcuaccggcuauuc

SEQ ID NO: 142025 - RNA, 80 nt, Human
agucuguuguuguaaacauccccgacuggaagcuguaagacacagcuaagcuuucagucagauguuugcugcuaccggcu

SEQ ID NO: 142026 - RNA, 114 nt, Human
ggguaccagaugugcuuccuguccucaguaaagaacuuggaguauguuguuccucaaauaucuuuugaugaaugggugcuccaggaguuucuacugacaggcuacauuuuaucc

SEQ ID NO: 142027 - RNA, 102 nt, Human
agaugugcuuccuguccucaguaaagaacuuggaguauguuguuccucaaauaucuuuugaugaaugggugcuccaggaguuucuacugacaggcuacauuu

SEQ ID NO: 142028 - RNA, 84 nt, Human
ccuguccucaguaaagaacuuggaguauguuguuccucaaauaucuuuugaugaaugggugcuccaggaguuucuacugacagg

SEQ ID NO: 142029 - RNA, 82 nt, Human; identical to SEQ ID NO: 140508

SEQ ID NO: 142030 - RNA, 102 nt, Human
ugaggcaggagaauagcuugaacccaggagguggagguugcagugagucgagauugcaccauugcacuccagccugggcaacaagagcaaaacucugucuca

SEQ ID NO: 142031 - RNA, 100 nt, Human
gagacaggagaaucgcuugaaccccagagguggagguuguggugagccgagauugcaccauugcacuccagccugggcaacaagagcgaaacuccgucuc

SEQ ID NO: 142032 - RNA, 82 nt, Human; identical to SEQ ID NO: 140508

SEQ ID NO: 142033 - RNA, 126 nt, Human
gugacugcaggcgacccuuaccgaggauuuuauucaaguauccaggggaggcuucugcugaacagcacauuguauaagcagcguuuuccuucuuuaauccuguaaucaauaccucucugccuuuac

SEQ ID NO: 142034 - RNA, 82 nt, Human; identical to SEQ ID NO: 140508

SEQ ID NO: 142035 - RNA, 99 nt, Human
gaggcaggagaauugcuugagcccaggaggcggagauugcagugagccgagaucgugccacugcacuccagccugggcaacagagugagacucugucuc

SEQ ID NO: 142036 - RNA, 111 nt, Human
uagacuugggagggaaccuuacaguccucuacuccagcucccugauuuuacagaucggggacccaccauucagggcugauaacaaacucaggucucuucacccucagucug

SEQ ID NO: 142037 - RNA, 110 nt, Human
aagaggccuaaaaguuuaaugccagaccuuaggggcaggauggagcagggcuaaaagaugucucuuugggccugucugccugcuuuccuuccuuccuuuucuuuccuuuu

SEQ ID NO: 142038 - RNA, 90 nt, Human
augcuuccuggcaucccuucccuaagcacuagcucugugcaaacccuuuucucaggcucugcuuucuggggggaucccaggcuaacacau

SEQ ID NO: 142039 - RNA, 85 nt, Human
cuguuagaccgagaccaaagccaucuguauuuaggacaugggcugaacccagaugucacacuuggugguuuuggucuccugaugg

SEQ ID NO: 142040 - RNA, 93 nt, Human
cuugacaccuccuguccaguacugucuugaugccugccccauaaagugacucugcgaugggcaaguguuaugaucagauuggaggguguaaag

SEQ ID NO: 142041 - RNA, 85 nt, Human
acaccuccuguccaguacugucuugaugccugccccauaaagugacucugcgaugggcaaguguuaugaucagauuggagggugu

SEQ ID NO: 142042 - RNA, 101 nt, Human
gaguuugagaucugucugggcaacaugcugaaaccccagcucuguaaacaauacaaaaauuagcugggcguggcggucugugccuacagucccagcuacuc

SEQ ID NO: 142043 - RNA, 78 nt, Human
cugucugggcaacaugcugaaaccccagcucuguaaacaauacaaaaauuagcugggcguggcggucugugccuacag

SEQ ID NO: 142044 - RNA, 81 nt, Human
uucacgcuugaaccugggagguggagguugcagugagccgagaucaugccauugcacuccagccugggcaacaagagugaa

SEQ ID NO: 142045 - RNA, 82 nt, Human; identical to SEQ ID NO: 140508

SEQ ID NO: 142046 - RNA, 101 nt, Human
ugagguaggagaaucacaugaacccgggagguggagguugcagugagccgagaccacgccauugcacaccaaccugggcaacagacugagacucugucuca

SEQ ID NO: 142047 - RNA, 113 nt, Human
uuccgauaaaagaguugccaagacccuuggaagcuccacaguaaugggugucuuucgguguccugaugagaugacugguggcugggggccucgaggagaguuucaaguuggag

SEQ ID NO: 142048 - RNA, 75 nt, Human
guguugagauccuuucacaguugugguuacaauuacguucacaagcuacaccugccaugagagaauacuuggcac

SEQ ID NO: 142049 - RNA, 82 nt, Human; identical to SEQ ID NO: 140508

SEQ ID NO: 142050 - RNA, 82 nt, Human; identical to SEQ ID NO: 140508

SEQ ID NO: 142051 - RNA, 82 nt, Human; identical to SEQ ID NO: 140508

SEQ ID NO: 142052 - RNA, 111 nt, Human
ucuccuguuaguucuguccuucuagggaaccuugacuaacacacaaguauaccaguuagguuaguuagguuuguugucgugguucagauagugauaguggcccacuggaga

SEQ ID NO: 142053 - RNA, 102 nt, Human
ugaggcaagagaaucgcuugaacccaggaggcagagguugaagugagccgagaucgugccauugcacuccagccugggcaacaagagcgaaacuccgucuca

SEQ ID NO: 142054 - RNA, 100 nt, Human
gaggcaagagaaucgcuugaacccaggaggcagagguugaagugagccgagaucgugccauugcacuccagccugggcaacaagagcgaaacuccgucuc

SEQ ID NO: 142055 - RNA, 109 nt, Human
uacuugugcagguuuguuaaauggguuuauuguguaaugcugagauuugggcuucuaaugaucccauugcccaaguagcaaacauaguaccuaauagaaucaauaggua

SEQ ID NO: 142056 - RNA, 112 nt, Human
gaugaugcuggcucuggggcuuuguagucacuagggcaccauuuugaaacaaugcacaaucaucuacuaaacggaaccacuagugacuugaaagccccugggccuuaucuuc

SEQ ID NO: 142057 - RNA, 85 nt, Human
gcaaagcacuuacuucuuugcagaugagacugagacauaguuacaaagucucaguuuccucugcaaacaguuguaagugcuuagc

SEQ ID NO: 142058 - RNA, 79 nt, Human
aagcacuuacuucuuugcagaugagacugagacauaguuacaaagucucaguuuccucugcaaacaguuguaagugcuu

SEQ ID NO: 142059 - RNA, 95 nt, Human
aucagugccagaaauuccuuaccuaaaguggcauaugcgacggccauggacugguucauagccgucuguuaugccuuuguauuuucugcacugau

SEQ ID NO: 142060 - RNA, 94 nt, Human
uccuauuccaucugcauuuuagaggugaagaauaacguacaagggauucagugauuagcaagggaccccucacuaaguguugauggaguuagga

SEQ ID NO: 142061 - RNA, 88 nt, Human
uuggaguuaggauccccagguucuaguccugagucuggacucuggguaagugacucagcgauucugaaccuuguuuccuuaucuuuga

SEQ ID NO: 142062 - RNA, 108 nt, Human
auuacuagguuuaaauaagaacagaugcuugcuuugguucaaguuaggcaugccucugaugcauuucuuaauaccaaggcaaaucucugagggcuuagacuuaguagu

SEQ ID NO: 142063 - RNA, 99 nt, Human
ugaggcaggagaaucgcuugaaccugggagguggagguuguggugagccgagaucgcgccauugcacuccagccugggcaagagcaaaacucugucuca

SEQ ID NO: 142064 - RNA, 97 nt, Human
gaggcaggagaaucgcuugaaccugggagguggagguuguggugagccgagaucgcgccauugcacuccagccugggcaagagcaaaacucugucuc

SEQ ID NO: 142065 - RNA, 106 nt, Human
aaguaucauuuaggcagggcgauuccaaagaaaacaauuaggcacauuacucaguggcuuuugggguuuccucugccuguccaaagaaaacacaccaaugauauuu

SEQ ID NO: 142066 - RNA, 104 nt, Human
aguaucauuuaggcagggcgauuccaaagaaaacaauuaggcacauuacucaguggcuuuugggguuuccucugccuguccaaagaaaacacaccaaugauauu

SEQ ID NO: 142067 - RNA, 102 nt, Human
agcucaucacagucuagcuucuugucuuuucauuucuuuuuaugguauuucuuuugacuaagaaauacuuuuaauguaaugucgaucuuuuccuguauggcu

SEQ ID NO: 142068 - RNA, 82 nt, Human; identical to SEQ ID NO: 140589

SEQ ID NO: 142069 - RNA, 82 nt, Human; identical to SEQ ID NO: 140508

SEQ ID NO: 142070 - RNA, 85 nt, Human
gguggugagaggggccuggggcgugguguggagggucgaguucuuugucgucccacagucacccccaggaccaccuugcgaagcc

SEQ ID NO: 142071 - RNA, 102 nt, Human
uuccaagugaaaauagacuuucuggaggagcagaaaggacagcucuugguaucuugcuguccugagaacugcuccaguuaaauauauuuguauuuagaggaa

SEQ ID NO: 142072 - RNA, 83 nt, Human
gugcauuucuauuucuaguuuuucacggaacugaccaggcaauucagucaguagcugucaaaacuggaguccagaacaggcac

SEQ ID NO: 142073 - RNA, 76 nt, Human
uugcuugaacccgggaggcagagguugcagugagcugagauggugccacugcacuccagccugggcaacagagcaa

SEQ ID NO: 142074 - RNA, 95 nt, Human
ugucuguguaagaacacguuugaaugcuguacaaggcacauaugugaacauuguaccacauguacagcuuucaaacaugcucuuauauucuccca

SEQ ID NO: 142075 - RNA, 82 nt, Human; identical to SEQ ID NO: 140508

SEQ ID NO: 142076 - RNA, 60 nt, Human
caugaaauuuagugugauuauuuuuucuacuuuuuaaucaucauuauuuugaaguuuaug

SEQ ID NO: 142077 - RNA, 82 nt, Human; identical to SEQ ID NO: 140508

SEQ ID NO: 142078 - RNA, 82 nt, Human; identical to SEQ ID NO: 140508

SEQ ID NO: 142079 - RNA, 82 nt, Human; identical to SEQ ID NO: 140508

SEQ ID NO: 142080 - RNA, 71 nt, Human
cuuuuccaccaucuaagagaaaggaaguucagagccuuagcuucaacaccacaauuucuuaacuggaaaag

SEQ ID NO: 142081 - RNA, 102 nt, Human
ugaggcaggagaaucgcuugaagccgugagguggagguuuuggugagcugagaucgcgccauugcacuccagccugggcaacaagagcgaaacucugucuca

SEQ ID NO: 142082 - RNA, 88 nt, Human
ggaguaucgcuugaaccugcgaggcggagguugcagugagccgggaucgcaccacugcacuccagccugggcaacagagugagacucc

SEQ ID NO: 142083 - RNA, 101 nt, Human; identical to SEQ ID NO: 141139

SEQ ID NO: 142084 - RNA, 82 nt, Human; identical to SEQ ID NO: 140508

SEQ ID NO: 142085 - RNA, 82 nt, Human; identical to SEQ ID NO: 140508

SEQ ID NO: 142086 - RNA, 97 nt, Human
aggcagaagaauugcuggaaucuaggaggcggagguugcagugagccaagaucgcgccacugcacuccagccugggcaacacagcgagacucugucu

SEQ ID NO: 142087 - RNA, 88 nt, Human
ggagaaucgcuugaacccaggaggcagagguugcagugagccaagaucaugccacugcacuccagccugggcaacagagugagacucc

SEQ ID NO: 142088 - RNA, 96 nt, Human
agagggagaauugcuugagcccaggauuucgaggcugcagugagcuaugaucacaccacugcacuccagccugggcaacagagcaagacucugucu

SEQ ID NO: 142089 - RNA, 94 nt, Human
gagggagaauugcuugagcccaggauuucgaggcugcagugagcuaugaucacaccacugcacuccagccugggcaacagagcaagacucuguc

SEQ ID NO: 142090 - RNA, 89 nt, Human
ggagaaucucuugaacccgggagguggagguuggggugagccgagaccgcgccauugcacuccagccugggcaacaagagugagacucc

SEQ ID NO: 142091 - RNA, 79 nt, Human
aaguguucuccugaggacccuuaggucagacagagaagcuuucucuuucugaugggaagggucaaaguggaaaucucuu

SEQ ID NO: 142092 - RNA, 97 nt, Human
cacuguagggcaguaaggaaagaauguucuuuuucaaaaauagucugagccaauuggauguuuuuguggaauauuuuuuuaauuugcccugcaugug

SEQ ID NO: 142093 - RNA, 122 nt, Human
uggaguauuuaagagugacuuaaacaacagauguucauacucugccaguucuggagguuggaaaguccaagaucagggugcuggcagauuugguugcuguuggguucucuucuuggcucgca

SEQ ID NO: 142094 - RNA, 83 nt, Human
ugggggcacuggcuucugcucuugcucuuucuucuggaaacauuauucuguuccuuuggacaugggcaaggguccugucccua

SEQ ID NO: 142095 - RNA, 96 nt, Human
ccuuggcccugugaggcuucaccucuugagccugagaagcagaggugacaguacuggcccugguucuuagcagggggguggcgggcaggguagggg

SEQ ID NO: 142096 - RNA, 65 nt, Human
ggcauggcagagccuugauuuguaauguuugcuaauuuacgugguacaagugcuccaguacggcc

SEQ ID NO: 142097 - RNA, 116 nt, Human
gaaauguggagaauuaaaaaggguagugaggcuggcauuuauagaaucuggcuuucuuguauuggguggaaagcuagaugaaaccaguuucucucagccuuuucucuccucagguc

SEQ ID NO: 142098 - RNA, 84 nt, Human
acucuugagcucccuccacuucugaggacguuuccugacacauucaacagcaucagcguccaaucaggagggagcucaaagagu

SEQ ID NO: 142099 - RNA, 74 nt, Human
guggguggugcagggguggucuuaggagggcuuuccugaaggaguggccaggguucacccaucuuuccacccac

SEQ ID NO: 142100 - RNA, 84 nt, Human
caccccguucauguaacacgggccugaggucagcaguagaggaccaguauugguuuuggccccagccucugcguggauggauug

SEQ ID NO: 142101 - RNA, 97 nt, Human
uggccaugcacaguggcucgcaacuguaaucucagcacuuucggaagccaaggcggucagaucaccugaggucaggaguucgagaccagucuggcca

SEQ ID NO: 142102 - RNA, 90 nt, Human
ggugcacccuguggaauuuggcagaaaaggcccaaucgcccuuuagagggugaacugaagccuguuccugcaauguucuaaggagugccc

SEQ ID NO: 142103 - RNA, 75 nt, Human
cccagcccugaccguucugcauaugaacaugggccuugguuuccccaucuguaugaagaagggaguagggcuggg

SEQ ID NO: 142104 - RNA, 105 nt, Human
cugaggcaggagaaauugcuugaacccaggagguagagguugcagugagucaagaucaugccauugcacuccaaccugggcgacaagagcaaaacucugucucag

SEQ ID NO: 142105 - RNA, 113 nt, Human; identical to SEQ ID NO: 141050

SEQ ID NO: 142106 - RNA, 94 nt, Human
ucccugaccacaccuuuacucagaagucuaaggaacagacuguuuaaccuguuuccagugguuucagggacuucuguauuggguguagcaagga

SEQ ID NO: 142107 - RNA, 71 nt, Human
gucacccauauuaaaaugcacaggggccaggcaugguggcuuaugccuguaaucccagcauuuugggaggc

SEQ ID NO: 142108 - RNA, 124 nt, Human
uucugaacuugggccagaucuuaaccugcugguaaagcacuggcugaggguuuagacuuucaaggaauuugagguuguuuucccugccuuauugcaacccagugucuggcugcugagaccagag

SEQ ID NO: 142109 - RNA, 117 nt, Human
uuugcgcuauuaaaggcaagcugauauaaauuagaacucuucugaaugggccuucuauauuuaaaugggcuuuuucuaggaaguguauauuuguaaacuugucuugaauggaaaaaa

SEQ ID NO: 142110 - RNA, 108 nt, Human
uuuugagauuuuauugaguacuacuaaucuugacauauuuugguuggcaccacauucuugguauaguggguuagugguugaauaguuugcagacuuugugaaacaaaa

SEQ ID NO: 142111 - RNA, 94 nt, Human
gauucaaagcaagaugguagcauuggagaggaugagauauggucagaugaggauauauuuuaaaaguugagcuaacaggauuugcugaggaauc

SEQ ID NO: 142112 - RNA, 73 nt, Human
ucccuucagagcccauggguuucccauucccuccugucagcccuggccaugaaauccuggggaucuggaggga

SEQ ID NO: 142113 - RNA, 94 nt, Human
ugucccuuccaagcuguguuaacuguucaaacucaggccugugugacuccauuggggugagaggugaaagcauaacauggguacagaggggaca

SEQ ID NO: 142114 - RNA, 118 nt, Human
acaauaauugaaauauuuucaagcugauuacaccgcagcccgaggcuagccugguugcuaagggugagcuccgcgguugcuagggggaguaaaucaucuugcauuauuugauuuuugu

SEQ ID NO: 142115 - RNA, 83 nt, Human
gugcaguacaaagacaguucagugacaaguuccauccauaccauggaagaggguuaaacuuguggcuguuuuugccacagcau

SEQ ID NO: 142116 - RNA, 89 nt, Human
gcagcaggcagggccaggcagggccgggccuggggccugguguccgaccgcagcccagccccccucaucgccugacacucugccucugc

SEQ ID NO: 142117 - RNA, 124 nt, Human
agaguauaccugugcccgguugcuguagcucaugccuguaaucccaccacuuugggaggccaaggcggguggaucauuugagguuaguaguuugagaccagcuuggccaacauggggaaacucu

SEQ ID NO: 142118 - RNA, 92 nt, Human
cuucuugcaggcaguguuguuccugauugccccagucuaguuuaucgcaagggaauuucuuugcggggcagugagcucccuuuuggcagaag

SEQ ID NO: 142119 - RNA, 86 nt, Human
guuuugaaggaugcgguguggagccagaggaugugugggagggguuucucuaacacugacuucuauuccaugagcuuuuucaaggc

SEQ ID NO: 142120 - RNA, 118 nt, Human
ggaaauguggagaauuaaaaaggguagugaggcuggcauuuauagaaucuggcuuucuuguauuggguggaaagcuagaugaaaccaguuucucucagccuuuucucuccucaggucu

SEQ ID NO: 142121 - RNA, 73 nt, Human
ggcgucacugcccugaugggcgguugggaaggcaaaaccugcccugaaaagccuuuggguagugauucuagcc

SEQ ID NO: 142122 - RNA, 106 nt, Human
uccccuaggccagauuaucuuaucagcuacugacccaguuagcuuuccuacuucacaacagguuucuaaugcuuuaugucagugugagagaaauggcaaguuggga

SEQ ID NO: 142123 - RNA, 91 nt, Human
aagcugggggcacuggcuucugcucuugcucuuucuucuggaaacauuauucuguuccuuuggacaugggcaaggguccugucccuaacuu

SEQ ID NO: 142124 - RNA, 129 nt, Human
agggcaagauccucgcuccaaccguggcccguguucucuccuuuuguccccauagugugacuccgccaggaacuuggaauggcugaagacugugaaugagagucaugggucuguggaacgcucaucccu

SEQ ID NO: 142125 - RNA, 131 nt, Human
cucugugaugcuuggggaccggcuccucggucacaccccaguccugcucugaagguugccguuuuccaaacagaaggaugguagcuagaggggagauagcaagauucuggagucuggaaagccuucacuug

SEQ ID NO: 142126 - RNA, 74 nt, Human
guagucccagcuauucaggagcuugaggugggaggaucacuucggcccaggagucugaggcuggagugagcuau

SEQ ID NO: 142127 - RNA, 112 nt, Human
ccuagaugggaucugcugcaggcaagauauucccggccucagaagcugaggggagaaccuucuguucuuccccaccuucggcuugcauuccuccuucagcaucuucuuaagg

SEQ ID NO: 142128 - RNA, 71 nt, Human
ucucccaggcaauauuccaggauaggcugccaguuggacuaaggaagccacuccugcggaacccugggaga

SEQ ID NO: 142129 - RNA, 94 nt, Human
cccaagguuacuugguaaguaaagagagaagccagaagccuggggccuccugacggcuccugcuucucuuuuuacuaaggucuucugccauggg

SEQ ID NO: 142130 - RNA, 131 nt, Human
ggcaagauccucgcuccaaccguggcccguguucucuccuuuuguccccauagugugacuccgccaggaacuuggaauggcugaagacugugaaugagagucaugggucuguggaacgcucaucccugacc

SEQ ID NO: 142131 - RNA, 77 nt, Human
gcaaagcaaguggcuuggagagauagugauuuagcucaagagggagugagaugugacuguugccacauguuaaaugc

SEQ ID NO: 142132 - RNA, 96 nt, Human
uagucucauccagguaugacaugugccacugugucugaaauuccugagcaccgagggccgcuucaggcaccaggcacuuugccaaccugagagcug

SEQ ID NO: 142133 - RNA, 96 nt, Human
cugccuaaugaugguguauggaagcuguagcauuucuggcaccugccaacuugucagagcugccuuucccuuccuggcacuuugucuauguggcag

SEQ ID NO: 142134 - RNA, 71 nt, Human
agcagaggcuggggaauggggguucugcucucacugaaugguggggaaccuucaacugcuuagccugugcu

SEQ ID NO: 142135 - RNA, 95 nt, Human
aagagacuuuguagaugugauuaaauuaaggcucuugagauugggagauuauccuggauuaucagaguaggcuugauguaaucacaagaguccuu

SEQ ID NO: 142136 - RNA, 99 nt, Human
guccacugauauucacuagccuguuuguccucaccccugaagcagauaaacacauguagauggaggaaaagugacaggcagguggguucaucagugggc

SEQ ID NO: 142137 - RNA, 98 nt, Human
cugcagcuccaauaaaauugccgagaugauguuuggguuugugcuggacauuccugagaggagccagaggugagucuugauuuuguuggggagagcag

SEQ ID NO: 142138 - RNA, 124 nt, Human
ucacccagugguucucucagcaacagacauguccaguggaccguaguguugugacggucgcccaucugcgcccaguaccucggaucaugcggaacauguugucaaagcugcagauugccuguga

SEQ ID NO: 142139 - RNA, 131 nt, Human
cgagugauuuuugagguaaguauguuauuggaaaggugugaucuauauagaacccuguacaugaaaaggaggagaugccgcuaucuuggcagggaugaucauguauuugaaauaguaacucacagcauuug

SEQ ID NO: 142140 - RNA, 114 nt, Human
cuguuuccuauaggugcugucagaucagguuccugauuggaguucucuuaucugcucugguuuggagggcugccccauucgggaaucuguuuuguuuugcucaaauacacucag

SEQ ID NO: 142141 - RNA, 65 nt, Human
ggguucuuuuuccgcuuucugagcccuuuuauaccuuacguuuagaaggggaaaaucauccuccc

SEQ ID NO: 142142 - RNA, 99 nt, Human; identical to SEQ ID NO: 141607

SEQ ID NO: 142143 - RNA, 86 nt, Human
uccaguucuucugggagaaaaauggcaggcuucuggggaaagaaagccagcugaauuuugacuccaucuccccagaagaugcuggg

SEQ ID NO: 142144 - RNA, 130 nt, Human
ucacgucucugcaaaguagcaagugguuauguucauaucauuuugaaagcugaguggauagauuuaaauagcaagagcuuuguucggaaugauguguggaacccagaaucacagacccugcgauacauga

SEQ ID NO: 142145 - RNA, 88 nt, Human
caagcagugaagggugcagaucauggauagagcuuucaagaaguuuguucuaguucuucuccugaaacuggaccucccuccuagcuug

SEQ ID NO: 142146 - RNA, 79 nt, Human
cagguaugacaugugccacugugucugaaauuccugagcaccgagggccgcuucaggcaccaggcacuuugccaaccug

SEQ ID NO: 142147 - RNA, 130 nt, Human
cauggggucgugucacugggcuccucagggaaggcaguagguuguauaguuaucuuccgaggggcaacaucacugcccugaaaccacacaaccuacuaccucaccccgccaggcccggccuugcacugcg

SEQ ID NO: 142148 - RNA, 74 nt, Human
ugcucuguugccuaggcuggagugcagugaugcaauuuuggcucacugcaaccuccaccuccuggguucaagca

SEQ ID NO: 142149 - RNA, 96 nt, Human
ucccagauucuuccugguggaggcauucggagagcaacacccuggccuuaacacacuacauaucuuugaauuucacacgggggcagccuucuggga

SEQ ID NO: 142150 - RNA, 117 nt, Human
gaauaaauaagcugcucuaauugccaagaauucacaugugguuguaugcagcauuacugggaaauugaaguguaucugcaugugauucugcugugauggacacuuguaaguuuguuc

SEQ ID NO: 142151 - RNA, 115 nt, Human
gggugcauggacuaggacccuggaggcagaaauaguuaccgaggggaaguuacaggccugagugugagucccuguuugguugcugaugagcuuugagguccuuggccagacacuc

SEQ ID NO: 142152 - RNA, 108 nt, Human
ccucagcagacaucagaaaauucaugcucggaagaaugccuacaggaaugaaaacuuaauaauugugggaaauacuugagcaaaauaucugguuucaugguauguagg

SEQ ID NO: 142153 - RNA, 87 nt, Human
gugcuagggggucaccuaugugggagccagcucugccuccugccccgaagcuccagagacuucuccuacaacugacucucuggacac

SEQ ID NO: 142154 - RNA, 118 nt, Human
ccauuuuuuuguaggucagaagugguugcaaacuggauuuuuagacucuuccuguugggggucucggacauuugcucuuuuccacagcggccaauucuucagagccacaaagaacugg

SEQ ID NO: 142155 - RNA, 123 nt, Human
ucaucuauccccuaggccagauuaucuuaucagcuacugacccaguuagcuuuccuacuucacaacagguuucuaaugcuuuaugucagugugagagaaauggcaaguugggaaaauuuguga

SEQ ID NO: 142156 - RNA, 76 nt, Human
ucacucugucgcccaggcuggagugcagugguacagccucagcucacugcaaccuccaccucccgggcucaaguga

SEQ ID NO: 142157 - RNA, 125 nt, Human
agugucuccagauugcacgaacauuucauuuuucacacagggucaccagaauaccaucaauuuuuugguaucacugucaaaagugauccuagcaccuucugaaauaacgugagcugccagauucu

SEQ ID NO: 142158 - RNA, 101 nt, Human
uggacuaggacccuggaggcagaaauaguuaccgaggggaaguuacaggccugagugugagucccuguuugguugcugaugagcuuugagguccuuggcca

SEQ ID NO: 142159 - RNA, 111 nt, Human
gcagguccaucuucaguggcauugggccuuggcugggaugcugaguuauccacuggagcaucggcaguacaggcaggcacagaggcaguggauccaucggagguggcaggu

SEQ ID NO: 142160 - RNA, 86 nt, Human
auuaugugcuguaguauguauauaguauuuuuagugaaaauauucauauaaaauauuacuuaaaucauuucuacauugcacaaaau

SEQ ID NO: 142161 - RNA, 101 nt, Human
aguuuaaggaugucgcaaagucuggguggccuucaguccaugaaagagaacacaucuguucuaucucaggcugaggucaucugcauccucaucaauaagcu

SEQ ID NO: 142162 - RNA, 71 nt, Human
gcuggggagggaguuuacauguuuucuaauggagccauuaucuguuggaggcauucauuccccucaccagc

SEQ ID NO: 142163 - RNA, 129 nt, Human
aauguaaaccccuuaaagcagauguguguggggccuuaugaagaccaggauucugcgggugucaggggauugccccucuugacagagacuaggguuuuagacugaggcuuccugcaggguguucgcauu

SEQ ID NO: 142164 - RNA, 130 nt, Human
acuaaaaucaacacaauaauugaaauauuuucaagcugauuacaccgcagcccgaggcuagccugguugcuaagggugagcuccgcgguugcuagggggaguaaaucaucuugcauuauuugauuuuugu

SEQ ID NO: 142165 - RNA, 64 nt, Human
ggauuuggcaaagaaggcaguacaguuaauccuggcugcaacugcuggaaaauuugcuacaccc

SEQ ID NO: 142166 - RNA, 78 nt, Human
acucuauuuuauucaaauggcacuaugauaugaguucaaaaaauuuuugaaacaguguccuuuguuuugagauggagu

SEQ ID NO: 142167 - RNA, 85 nt, Human
ggccaggacucuugcagaacugagaccugggagcuccucccucaccaggaagggacccgaggcaggcggcgggggucucugagcc

SEQ ID NO: 142168 - RNA, 96 nt, Human
augacugugcugcaggaggcggcucagugugaagaacuacggguuuccugauguugaagcucagaauuagccacacugaccuucucagucaugcau

SEQ ID NO: 142169 - RNA, 90 nt, Human
cagggagaagagcugugugcugugaugugguuuauaaauuaccauuuggaaggagcugcacagcacagcagccugcaacuacucuuccug

SEQ ID NO: 142170 - RNA, 106 nt, Human
cuuugagaugacugguauugaauggagcagucuuugaaaggcaccaacccuuccuaacugaugguggucucuugaaagaggcucuuccaaauuugucuucugaaag

SEQ ID NO: 142171 - RNA, 74 nt, Human
guagaggugggguuucuccauguuggucaggcuggucuuuaacuccugaccucaggugauacgcccgccuuggc

SEQ ID NO: 142172 - RNA, 92 nt, Human
cugaaucaugcaguguauacaggaugucagugaagaggucuggcaggaaugccucacucucuuccuacugacugguacauguuaugaugcag

SEQ ID NO: 142173 - RNA, 104 nt, Human
gcugucuauuaugagucugacuggcacagacaucugucaaggaagaaggauucuuugagcguauuugugucagucaacugcauauauggaccacaacagaaagc

SEQ ID NO: 142174 - RNA, 80 nt, Human
cccuuucaaaacaaagcuuucccaggauagcccugggcagaacuccugggauugacugggcaguaauguaguugagaggg

SEQ ID NO: 142175 - RNA, 88 nt, Human
ccuccugugucccaaaacgaaaacacuccuauauuuuguagcgccuuccagaauggggcagcggaaacuaguguugggacaaaggagg

SEQ ID NO: 142176 - RNA, 82 nt, Human; identical to SEQ ID NO: 141519

SEQ ID NO: 142177 - RNA, 99 nt, Human
gagguaggagaacugcuugaacucaggaggcgggggcugcaaugagcugagaucaagccacugcacuccagccuaugggauagagugagauuccaucuc

SEQ ID NO: 142178 - RNA, 113 nt, Human; identical to SEQ ID NO: 141436

SEQ ID NO: 142179 - RNA, 102 nt, Human
cugucucugggcccugucugaggcuucuuaagauguuguuacaauaaucuacuauguggagugucuggaggugucucuuacuucucuggcauuaagagacag

SEQ ID NO: 142180 - RNA, 112 nt, Human
guccuuuagucucuauuuuugcuccuaauuguuccugcagguaguagguuaacauguaacguacuuacagaaggaagcaauugaacauggcauagauacugaaagaaagggc

SEQ ID NO: 142181 - RNA, 107 nt, Human
agcaaggacaaguugugaccuucccaguccucucuccauuugcagaucagcaagcuucugucagcaaggagggguggacaaugaaacuggguucagcuugauuuguu

SEQ ID NO: 142182 - RNA, 89 nt, Human
ggagaauugcuugaacccggguggcggagguuguggugagugaagauugcacuauugcacuccagccugggcaacaagagugaaacucc

SEQ ID NO: 142183 - RNA, 127 nt, Human
ucucucuucccucucaucauagauuaaucacuuaguugcaagggaccaguaaauuaacagaauggugaacauuuuccuuuucuuggugcuuuugcuggaugacuagugguuucugcuggaacagaga

SEQ ID NO: 142184 - RNA, 76 nt, Human
gggaaagcagaagguuggggcuggaggucugcuggcaggcaggcagacauuuggagccaacuuuccugcucagccc

SEQ ID NO: 142185 - RNA, 90 nt, Human
ccucauugguucauucggcagcuguuuauuuagaaccugccgugugcuagggcagaucugggauacagcuguggacaagggaggaugagg

SEQ ID NO: 142186 - RNA, 86 nt, Human
ggaggggaggauacaagaggaaugauaaauggcaaggaaaaccacucacucuuaaugcuuuuugucauacucauguccucuugucc

SEQ ID NO: 142187 - RNA, 100 nt, Human
ccaucuucaguggcauugggccuuggcugggaugcugaguuauccacuggagcaucggcaguacaggcaggcacagaggcaguggauccaucggaggugg

SEQ ID NO: 142188 - RNA, 107 nt, Human
gguaccuuauuauugaaaaucagauaaacuuugguuggguggguauuuggaggaaucuuuuaagucuuuucuuaagcaaaguuuggacauucuaaaauaagguugcc

SEQ ID NO: 142189 - RNA, 78 nt, Human
cucagguccuuuagugcuucucagucaacagacagggagggagcuuccccugugacugaggugcgcauaaagacugag

SEQ ID NO: 142190 - RNA, 86 nt, Human
agagucucauucuguugcccaggcaggagugcaauggugugaccucaggucacugcaaccucugcugccuggguucaagcgauucu

SEQ ID NO: 142191 - RNA, 81 nt, Human
uggagacugguagcuuauuaaagaaacuccguguuacucauuccuggaguuggggguuucuguaggcacuuuauuucucca

SEQ ID NO: 142192 - RNA, 109 nt, Human
gcuuacaauugcugguaccugguagcauuuauuuucccucaaguaccuaguaaccuuaugaagguagggaggguagaugcucuaccacauuccuucagcuguauugagu

SEQ ID NO: 142193 - RNA, 109 nt, Human
cuggaggauuuggggugccccucucggcagggaacaggaaguaggaaucccagaagggucugggggaacccuaacccugagcucaguccaguucaccccucaccuccag

SEQ ID NO: 142194 - RNA, 130 nt, Human; identical to SEQ ID NO: 141589

SEQ ID NO: 142195 - RNA, 80 nt, Human
ucacccuguugccuaggcaggacggaaugcagugaagucaucauaguuuacuguaacacugaacuccugggcucaaguga

SEQ ID NO: 142196 - RNA, 74 nt, Human
gcuuccucaccaccuugugcacugcugcucccacaccacagugacuagcagcacauaaugguuugaauuaaagc

SEQ ID NO: 142197 - RNA, 93 nt, Human
ggcgcuggugucaaacaguuaugugaugcuuugaagcacccucacuguagaugagagugucuugcacugcaaacauagccgaucacccgugcc

SEQ ID NO: 142198 - RNA, 75 nt, Human; identical to SEQ ID NO: 141971

SEQ ID NO: 142199 - RNA, 84 nt, Human
aacuggucggugauuuagguaguuuccuguuguugggauccaccuuucucucgacagcacgacacugccuucauuacuucaguu

SEQ ID NO: 142200 - RNA, 92 nt, Human
uguggcucugccucccugucucacucucccuauaacuggccucucccugcucagaccuuccuggacgagcugcaugagacagggcagcugca

SEQ ID NO: 142201 - RNA, 52 nt, Human
uuuggaguaauucaguauagguucguuuaaaagagauuuuuauaacuucaga

SEQ ID NO: 142202 - RNA, 86 nt, Human
cauuagauucucauaagagcccaaacccuauugugagcugcacaugcaagggaucuagguugugcgcuccuuaugagaaucuaaug

SEQ ID NO: 142203 - RNA, 93 nt, Human
auuauucugaugaaaauccacaaugucuuugagcuucugguuguguaaugcugggguuuaaagucaccauuuguggguuuggcaucaauuaau

SEQ ID NO: 142204 - RNA, 99 nt, Human
cugccuauauuacauucauuuugaugguuuguaucucaaaggaguacagugaacgaaacuuguuuaaagauacaccggaaagaaaaagagaagaggcag

SEQ ID NO: 142205 - RNA, 98 nt, Human
uggaagaggggcagcuguugaaggcauucuuguaucaagggagguaggagggcccucugaugccaaaggcagccuucucaggcuauugcuuucuucca

SEQ ID NO: 142206 - RNA, 106 nt, Human
cuggauuccccaaagcucacaguuuggcacugaaucauauacaaucucguaguuuggauggcugugugugacugcagacugcuagacagcagggcccacaucacag

SEQ ID NO: 142207 - RNA, 110 nt, Human
ccccgagggugugacugagagccaguccccagcacccuuguccagauggggaccaggaggugggugaagauauuuggggucugagcucugugcugguugcccccgagggg

SEQ ID NO: 142208 - RNA, 95 nt, Human
ccagagauagcaccuucugacccagugcagauuggacgguuaauugguagguuggaguugagucucacguugaaacagaaugaagugcuuccugg

SEQ ID NO: 142209 - RNA, 94 nt, Human
gaaguggagaguguaggaaauccacugcagaaugaggucugcuugucauccucucagucucaacugcucucccuccuucaucgcucucuguuuc

SEQ ID NO: 142210 - RNA, 63 nt, Human
auacuuacuagcauauuauauagcucuaagaguguagaguuauaugaugugcuagugaagugu

SEQ ID NO: 142211 - RNA, 102 nt, Human
cugaaagucuaucugcugccacgccugggcacauacugcaucauuuacaaaacuguagagcaccuguugugugugcaguugugauuucuuauagauuuuuag

SEQ ID NO: 142212 - RNA, 73 nt, Human
uggccucucugugcuuccauuuccccaucuguaagauaggaauaacacaucucacaggagcauggagaggcua

SEQ ID NO: 142213 - RNA, 100 nt, Human
gaggcaggagaaucgcuugaacccaggaggcggagguuguggugagcgaagaucgugccauugcacuccagccugggcaacaagagcaaaacucugucuc

SEQ ID NO: 142214 - RNA, 101 nt, Human
agcagacugcccuguugaccagaauuuguuagauugcuauuacaaugcugauuauauuuuauagcaauuacugacauaagguuauacuuugggcaauggcu

SEQ ID NO: 142215 - RNA, 108 nt, Human
guaguuaccauugccuuuucugugagcuauuuguuuugguuugcugaaacuaguccaaaacaggaaauuuaacagacagccacagccaaagagugucaugugaauuac

SEQ ID NO: 142216 - RNA, 74 nt, Human
cgcucuuucacccaggcuggagugcaguggcaugaucucagcucacugcaaccuccaucuccuggguucaagcg

SEQ ID NO: 142217 - RNA, 130 nt, Human
uucuauguuauacccuggaguccugguugaggggugggggaaucagaaaaguagguuuacauuuaacauuuuucuuaacuacauucacuucuuaaaaaggaacaagaaguguaaauaaguauguauagag

SEQ ID NO: 142218 - RNA, 107 nt, Human
agagguguuccuuaggccacacccugcccucccuggacugccugaccucgcuccaaggcucaggggaagguucugagggcaggugugaaaaugcuuggaaugucccu

SEQ ID NO: 142219 - RNA, 107 nt, Human
ugggauuacagacaugagccacugugcccagccagggcuguguguuauguagugacagcucacugauacagcucucucuggggacuuaggaaccaaguuugacccca

SEQ ID NO: 142220 - RNA, 108 nt, Human
ccuucaaaaaguuuguagccuaucgggguggagagauaagccaaguauccagauaaccauggcauaaggcagaauauuuucuguacuaugagagguacaaaggggagg

SEQ ID NO: 142221 - RNA, 77 nt, Human
ugggaaaucugcuuccuagggcuguuagaaggaaauuggucuccuuaaauuacgucagcaucugaggcaguuuccua

SEQ ID NO: 142222 - RNA, 75 nt, Human
guguuuugcacuguaauaccucggucguagcaaagugccgugggaccgaaguauuauggugcagugacuugacgc

SEQ ID NO: 142223 - RNA, 87 nt, Human
cuuaccccaguauccuauuaucucauaccuaaggcagugaugguuucucagaccucuuagauugagaagauguggcauggguguaag

SEQ ID NO: 142224 - RNA, 89 nt, Human
uuuuagcauggcuuguaauagcaaacaguuuguaauagcaaugacguguuauuuauugcagcauuguuuguaauagcaaaauacuggaa

SEQ ID NO: 142225 - RNA, 86 nt, Human
uucccugagacucuuuaacuucuugaaaaaaguugaugcuguuuuauuugaaaaaucgucaagacuauuaaaaggcaaauagggga

SEQ ID NO: 142226 - RNA, 114 nt, Human
gaagcuaccugagguuuagaauuccuucagcccuagcugcuuuuauucugcuuuuuauuuaaacaaaaagagggggaggaucugaaggaaacuaguuuucuguacaaaggcuuu

SEQ ID NO: 142227 - RNA, 76 nt, Human
aguucagacauucuagacuguuccgucagacucaguuucaaaagagaaugugugggagaacagucuuuguccgacu

SEQ ID NO: 142228 - RNA, 101 nt, Human
ggagucuuaaacgugguagcucugugcuagagagugguaaccugauggcucccggaggaggugguauuaauccuuagcaucagggcaaaucuugagacucu

SEQ ID NO: 142229 - RNA, 76 nt, Human
ggcuuccucaccaccuugugcacugcugcucccacaccacagugacuagcagcacauaaugguuugaauuaaagcu

SEQ ID NO: 142230 - RNA, 59 nt, Human
gggaaauggcucaaacacaauccagggaagcucucuaugauauguguuugacauccccc

SEQ ID NO: 142231 - RNA, 103 nt, Human
ggaggaccuggccaaaguggguggugcagggguggucuuaggagggcuuuccugaaggaguggccaggguucacccaucuuuccacccacggacccauccucu

SEQ ID NO: 142232 - RNA, 100 nt, Human
cccagaacaaagaccucuagccaacauguaagcaccuagaccaugguuucccauccuuaucauuguuaacauuuuggcuagauaguucuuuguugugugg

SEQ ID NO: 142233 - RNA, 102 nt, Human
cacgcgucuuuguggucaccuggcuuaggaagcucacaagguccucaucauuuggagguguuucccugugagugcccucagcccuaggcuuucuuacgugug

SEQ ID NO: 142234 - RNA, 76 nt, Human
gcucuuguugcccaggcuggagugcaguggcaugaucucagcucacugcaaccucugccaccuggguucaagcugu

SEQ ID NO: 142235 - RNA, 106 nt, Human
ccaugggcucauugugacaggaaaagugccugcugcugcuucuuuacacccacccuggccaacagaaguacacagugcaguucaccuucaagaaugaagcaucagg

SEQ ID NO: 142236 - RNA, 113 nt, Human
ugguucauaauauuccuugcagauguugaacgaugggcuggauuguuuuggaaccuuguuccagcagagcccauguguucaugaagaaaacauuugcuuacagcuuaugacua

SEQ ID NO: 142237 - RNA, 89 nt, Human
gcuaucaguucuugcuauucucagagcacucuaucauguuuuuagguguauauuguguauucaggauagcauuaaaaagaacugauggc

SEQ ID NO: 142238 - RNA, 91 nt, Human
acucuuaaaccuuuagaaaugcuacagcaucuagcuucucuagaucaauaaucacagaggcuuaagugcugaccucauaaagauaaagagu

SEQ ID NO: 142239 - RNA, 99 nt, Human
uaugagggacaugaacaccugcagauuuugggguccacagggguccuggaauuaauucccuguggauacugagagaugacuggacauccauucuccaug

SEQ ID NO: 142240 - RNA, 82 nt, Human
gacaggauuccaguacaggucucucauuuccuucaugauuaggaauacuacuuugaaaugagagaccuguacuguaucuguu

SEQ ID NO: 142241 - RNA, 85 nt, Human
ggaccagacuauugugacauggagaauguagaggaauuauucaauguucaggaucaacaugaucuccucacucuaggauggaucc

SEQ ID NO: 142242 - RNA, 88 nt, Human
ggggcagagcggauggaagccggagaucccagguucccggaauacuccggcuggggccuucgggcuucuccuguccccucccuacccc

SEQ ID NO: 142243 - RNA, 86 nt, Human
gagaaucacuugaacccaggagguggagguugcagugagccaagaucgugccauugcacuccagccuggguaacagagugggacuc

SEQ ID NO: 142244 - RNA, 106 nt, Human
uuauuugucaauauguggggauaaccuguagcugcauucaugagguagcaaauagcaguuuuggccuguggggugaacagcuaaacaguguucuggcaucagauaa

SEQ ID NO: 142245 - RNA, 96 nt, Human
caggaguacgacgcugugguagcuaugaucaugccacugcacuccagccugggugacagagcaagaucuagauaauuacacucuguccugcuccug

SEQ ID NO: 142246 - RNA, 84 nt, Human
agaaucgcuugaacccaggaggcggagguugcagugagccaggaucacgccacuguacuccacccugggcgacagagcgagacu

SEQ ID NO: 142247 - RNA, 106 nt, Human
ccagaggcugugaccauggcuaguagacaguggcaacauagucauccccaagaugcuaaucuucugcuggaacugucauacguuaucauggucaauguaaaccugg

SEQ ID NO: 142248 - RNA, 78 nt, Human
uggggugcucaucuucuguaacuguugggaaggcucggugguccauuuucaccaguuaaagaauaugaggccagccca

SEQ ID NO: 142249 - RNA, 88 nt, Human
ggagaaucacuuuaaccagagaguuggagguugcagggagccgagaucgcaccacugcacuccagccugggugacaaagcgagacucc

SEQ ID NO: 142250 - RNA, 105 nt, Human
uuccuccaguuuucagucacucaguagaugucuguacuaucauauccaucauaugaauauaucacauaugauagguaccaacuaucugagugaaaacuggaagaa

SEQ ID NO: 142251 - RNA, 78 nt, Human
ccuaaaacauaagugaagaucaggcuacagugcuuuucucaugacauggagccuuguuguuuguucacucauucuagg

SEQ ID NO: 142252 - RNA, 125 nt, Human
guaaaucucccugauaccaucacucuuaaaccuuuagaaaugcuacagcaucuagcuucucuagaucaauaaucacagaggcuuaagugcugaccucauaaagauaaagaguucccaugauuuac

SEQ ID NO: 142253 - RNA, 123 nt, Human
gcucacacagcaagucuuugucaaagcuuaggaauggaaguagguuguccccuccuagucaugggaucucuccaacucacuagacaaucuugcuuuacgugcugaugaacaugcucugugagc

SEQ ID NO: 142254 - RNA, 104 nt, Human
ugggcaaaaagugagaaaguaagacugugggaggugacuguuacagaucggaaaacucugauugaaccauucacuuuauuagccaguaaacuuucucaacccca

SEQ ID NO: 142255 - RNA, 59 nt, Human
ggcuugggccgaccccagagagagcccaucaccuucuuuuugggguuuggggcuuggcc

SEQ ID NO: 142256 - RNA, 77 nt, Human
aaguuacccugugacagucauucaucugugcucuggguggcccaugggaugaguguacuacugggcagguguaacuu

SEQ ID NO: 142257 - RNA, 101 nt, Human
uccacaguuugaucucuucucuguucccuccacacucuucuuuugcuccucuuccuguauuucagagugguuaagaucauggaagucagacaagcuauggg

SEQ ID NO: 142258 - RNA, 94 nt, Human
guucucuugagacuaguaggcauagaagaaagcagaaggaaaauaaauagaaagaaggucuucuaccuucauggcuauucaggcucaggagggu

SEQ ID NO: 142259 - RNA, 67 nt, Human
uuccaugggcaggggccaugacagggagauaggccacaccuuucccagguggaaccugcagauggag

SEQ ID NO: 142260 - RNA, 99 nt, Human
ugguggcauaugcguguaaucccagcuacuugggaggcugaggcaggagaauugcuugaacccaggagguggagguuacagugagcagagauugcacca

SEQ ID NO: 142261 - RNA, 84 nt, Human
cccagcccaagauugaauucugauuaaaggaggcugaauugcagagccuccuuucaucaaauucgaguuuugaauugagcuggg

SEQ ID NO: 142262 - RNA, 64 nt, Human
gaccagccauccugguuuacaugggacgcaggaacugccguuuuaaagcugggcugaguugguc

SEQ ID NO: 142263 - RNA, 85 nt, Human
gcuguuggugaguauggagaucucugcccuugucagaggaaggcuuccucaucacaaggcagggcaggugucugugcccaagagc

SEQ ID NO: 142264 - RNA, 80 nt, Human
uugguuagguaguggaaccuucuaaaugacgcacuaugugauuccugugucauauagaauguucuaugauucuuagccag

SEQ ID NO: 142265 - RNA, 68 nt, Human
ugauagcaacucugcuuccuugccucaggacagguuuguggcaaggaagaaagcagaaguugcuuuca

SEQ ID NO: 142266 - RNA, 130 nt, Human
uacuugggaucaguuagucuagagccugcaaagcaaguggcuuggagagauagugauuuagcucaagagggagugagaugugacuguugccacauguuaaaugcuuuucugggccugauuauuuaaggga

SEQ ID NO: 142267 - RNA, 66 nt, Human
guggcguuuauucccuuaguauguaggugacccaggguggcuuugcuuuggcaagggagaagucac

SEQ ID NO: 142268 - RNA, 72 nt, Human
acaugucauauugagccuccuacugaacucagccacauauggaaguuugaaguggguccucgaaaugcaugu

SEQ ID NO: 142269 - RNA, 76 nt, Human
ucagacuugcauuucaccaggcauucuuuagcugccugcggugcuaaagaauggguggcugggcugugugagauga

SEQ ID NO: 142270 - RNA, 106 nt, Human
uuuuggcccugugcucuugauaacagaguguuugagggacaacuuucacauuugaguuuuuccaaaauuaaagguuguagaagagucacaguaucuauugucaaaa

SEQ ID NO: 142271 - RNA, 78 nt, Human
uaaauuggaaugacagaagaugagagcuaggaagugguauauuuaauuucuagauuucagggcuggagugguggagua

SEQ ID NO: 142272 - RNA, 86 nt, Human
cucauagugguagauagcuuauuggucaggguagauagagauauguuuucuguguaacugucuaguuuuuguccuaccauucggag

SEQ ID NO: 142273 - RNA, 110 nt, Human
ucccggaguuuauggucuggugagaagaucccugcucugagucacugccaagcucuagcuaugugacuuugaacagggaauuucugucccuaucuauaaaauaaacgggg

SEQ ID NO: 142274 - RNA, 85 nt, Human
gagguaggugcuuuaacugugugcacccugugagguaggugcuuuaacugugugcacauugugagguaggugcugaaacugcuuc

SEQ ID NO: 142275 - RNA, 89 nt, Human
uagcaccccuugcccugugucuguggaacagaagcagcuuccuucagagaagacugcagcucccaaggacacaagcuguugggaugcua

SEQ ID NO: 142276 - RNA, 100 nt, Human
ugaggcaggagaaucacuugaaccugggaggcaagagguugcagugagcugagaucauaccacugcacucuggccuggguaacagagcgagacugucuca

SEQ ID NO: 142277 - RNA, 79 nt, Human
gugagauguguuccaggaagucgucuugagcacccauugcucagaguuuauauuggacuugcuuucuagcacauaccac

SEQ ID NO: 142278 - RNA, 69 nt, Human
agguggcagagaggcaauaucaauccuucugcaucacacagugggaaaaguuugucucauugcaguucu

SEQ ID NO: 142279 - RNA, 91 nt, Human
acacacgugagauguguuccaggaagucgucuugagcacccauugcucagaguuuauauuggacuugcuuucuagcacauaccacaauugu

SEQ ID NO: 142280 - RNA, 98 nt, Human
aggcaggagaauugcuugaacccaggagguggagguugcagggagucgagaucgugccacugcacuccagccugggcaaugagagcaaaacuccaucu

SEQ ID NO: 142281 - RNA, 97 nt, Human
aggcaggagaauugcuugaaccuggaaggcggagguugcagugagccaagauugugccacugcacuccagccugggcaacacagcgagacucugucu

SEQ ID NO: 142282 - RNA, 97 nt, Human
aggcaggagagucgcuggaaccugagaggcggagcuugcagugagccgagaucgcgccacugcacuccagccugggcaacacagcgagacuccgucu

SEQ ID NO: 142283 - RNA, 78 nt, Human
auggcgugaacccgggaggcggagcuugcagugagccgagaucgagccacugcacuccagccugggcaacagagcgau

SEQ ID NO: 142284 - RNA, 131 nt, Human
cuacucuggaggcugaggcaggagaaucgcuuuaacccgggaggcagagguuguggugagccgagaucgcgccauugcacuccagccugggcaacaagagcggaauucugucucaaaaaaaaaaaagagag

SEQ ID NO: 142285 - RNA, 121 nt, Human
cucaggaggcugaggcaggaggaucacuugagccugggaggucuaggcugcagugagccgggacgaugccacugcacuccagccugggcaacagagugagacccugucccagcacucuggg

SEQ ID NO: 142286 - RNA, 101 nt, Human
cugaggcagagaaucucuugaaccugggagguggagguugcagugagccgagauuguccacugcacuccagccugggcaacagaguaagacucugucucag

SEQ ID NO: 142287 - RNA, 104 nt, Human
cugaggcaggagaaucacuugaaccugggaaauggagguugcagugagccaagauugagccacugcacuccagccugggcaacaagagugaaacucugucucag

SEQ ID NO: 142288 - RNA, 68 nt, Human
cuggaacccaggaggaggagguuguggugagccaagaucgugccacugcacuccagccugggcaacag

SEQ ID NO: 142289 - RNA, 69 nt, Human
cuugaacccaggagguggagauugcagugagccgagaccacgccacugcacuccagccugggcaacaag

SEQ ID NO: 142290 - RNA, 69 nt, Human
cuugaacccgggagguggaggcugcagugaacccagacccugccacugcacuccagccugggcaacaag

SEQ ID NO: 142291 - RNA, 66 nt, Human
cuugaaccugggagguggaggcuacagugagcugagaucaugccacugcacuccagccugggcaag

SEQ ID NO: 142292 - RNA, 84 nt, Human
gaaucgcuugaaccugggaggaagagguugcagugagccgagauggcaccacugcacuccagccugggcaacagagcaagauuc

SEQ ID NO: 142293 - RNA, 131 nt, Human
gacagcuggaauguucugaagaacugggugaucuugugaaaucuguggacccuacauuggcacuuaguguguaccuaagggcuaacgucccaaauaaagucauucagugcuuugcagaaacaggucaaguc

SEQ ID NO: 142294 - RNA, 86 nt, Human
gagaaucgcuggaacccaggaggaggagguuguggugagccaagaucgugccacugcacuccagccugggcaacagaacaagacuc

SEQ ID NO: 142295 - RNA, 92 nt, Human
gagaaucgcuggaacccaggaggaggagguuguggugagccaagaucgugccacugcacuccagccugggcaacagaacaagacuccgucuc

SEQ ID NO: 142296 - RNA, 87 nt, Human
gagaaucgcuugaaccccggaggcagagauugcagugagccgagaucaugccacugcacuccagccugggcaacaagagcgaaacuc

SEQ ID NO: 142297 - RNA, 86 nt, Human
gagaauugcuugaacccgggagguggagguuguagugagccgagaucgcgccacugcacuccagccugggcaacagagugagacuc

SEQ ID NO: 142298 - RNA, 100 nt, Human
gagacaggagaaucgcuagaacccuagaggcagagguugcagugagcagagagagugccacugcacuccagccugggcaacaagagugaaauuccgucuc

SEQ ID NO: 142299 - RNA, 99 nt, Human
gagacaggagaauugcaugaacccaggaggcagagguugcagugagcugagcucgugccacugcacuccagccugggcaacaaagcgagacuccgucuc

SEQ ID NO: 142300 - RNA, 99 nt, Human
gagacaggagaauugcuugaaccuggcaggcggagguuacagugagccaagaugguaccacugcacuccagccugggcaacauagcaacacucugucuc

SEQ ID NO: 142301 - RNA, 99 nt, Human
gagaugggagguucacuugaacccaggagguggaggcuguggugagccaacauccugccacugcacuccagccugggcaacagagccaaacucugacuc

SEQ ID NO: 142302 - RNA, 82 nt, Human
gaggaucccugaguggggguugaggcugcagugagccaugaucaagccacugcacuccagccugggcaacacugagacacuc

SEQ ID NO: 142303 - RNA, 86 nt, Human
gaggaucccugaguggggguugaggcugcagugagccaugaucaagccacugcacuccagccugggcaacacugagacacucucuc

SEQ ID NO: 142304 - RNA, 99 nt, Human
gaggcagaagaaucacuucaaccugggagguggagguugcagugagcugacauugcgccacugcacuccagccugggcaacagagggacacucugucuc

SEQ ID NO: 142305 - RNA, 99 nt, Human
gaggcagaagaauggccugaacccaggaggcggagcuugcagugagcugagaucacgccacugcacuccagccugggcaacagagcaagacucugucuc

SEQ ID NO: 142306 - RNA, 96 nt, Human
gaggcagagaauugcucgaacccgggagacagagguugcagugagccgagauugugccacugcacuccagccugggcaacagagcgagacugcguc

SEQ ID NO: 142307 - RNA, 100 nt, Human
gaggcaggagaacagcuugaacccagguggcagagguugcagugagcugagaucaugccacugcacuccagccugggcaacaagagcgagacuccgucuc

SEQ ID NO: 142308 - RNA, 100 nt, Human
gaggcaggagaaucacuugaaccugggaaauggagguugcagugagccaagauugagccacugcacuccagccugggcaacaagagugaaacucugucuc

SEQ ID NO: 142309 - RNA, 100 nt, Human
gaggcaggagaaucacuugaaccugggagauggagguugcggugagccgagaucgcaucacugcacuccagccugggcaacaagagcgaaacucugucuc

SEQ ID NO: 142310 - RNA, 100 nt, Human
gaggcaggagaaucacuugaaccugggagguggagguugcagugagucgagauggcgccacugcacuccagccugggcaacaagagugaaacuccgucuc

SEQ ID NO: 142311 - RNA, 99 nt, Human
gaggcaggagaaucgcuugaacccaggagauggagguugcagugagcugagaucacgccacugcacuccagccugggcaacagagugagacuccgucuc

SEQ ID NO: 142312 - RNA, 100 nt, Human
gaggcaggagaaucgcuugaacccaggaggcggagguugcagugagccaagauugcgccacugcacuccagccugggcaacaaaagcaaaacuucgucuc

SEQ ID NO: 142313 - RNA, 99 nt, Human
gaggcaggagaaucgcuugaacccaggagguggagguugcagugugccgagaucgcgacacugcacuccagccugggcaacggagugaaauucugucuc

SEQ ID NO: 142314 - RNA, 98 nt, Human
gaggcaggagaaucgcuugaacccggggggaggagguuacagugagcugagaucgcgccacugcacuccagccugggcaacaagagugaaacugucuc

SEQ ID NO: 142315 - RNA, 99 nt, Human
gaggcaggagaaucgcuugaaccugggagguggagguugcagugagccgagaucaugccacugcacuccagccugggcaacagagcgagacuucgucuc

SEQ ID NO: 142316 - RNA, 99 nt, Human
gaggcaggagaauggcaugaacccaggaggcggagcuugcagugagccgagauugcgccacugcacuccagccugggcaacggagcaagacuccaucuc

SEQ ID NO: 142317 - RNA, 99 nt, Human
gaggcaggagaauggccugaaccuaggagguggagcuugcagugagccgagauagcgccacugcacuccagccugggcaacagagcgagacucugucuc

SEQ ID NO: 142318 - RNA, 100 nt, Human
gaggcaggagaauuacuugaaaccaggagguggagguugcggugagucgagaucgugccacugcacuccagccugggcaacaagagcaaaacuccgucuc

SEQ ID NO: 142319 - RNA, 99 nt, Human
gaggcaggagaauugcuugaacccaggaggcagaagcugcagugagccaagauagugccacugcacuccagccugggcaacagagcgagacuccgucuc

SEQ ID NO: 142320 - RNA, 97 nt, Human
gaggcaggagaauugcuugaacccaggaggcggagguuguagugagcugagaucacgccacugcacuccagccugggcaacagagcaagacugucuc

SEQ ID NO: 142321 - RNA, 99 nt, Human
gaggcaggagaauugcuugaaccugggaggcagagguugcagugagcugaaaucgcgccacugcacuccagccugggcaauagggcaagacuccgucuc

SEQ ID NO: 142322 - RNA, 99 nt, Human
gaggcaggagaauugcuugaaccugggaggugaagguugcagugagcugagaccaugccacugcacuccagccugggcaacagagcaaaacuccgucuc

SEQ ID NO: 142323 - RNA, 98 nt, Human
gaggcaggagaauugcuugaacucagggucagaggucgcagugagccgagaucccuccacugcacuccagccugggcaacagagugagucucugucuc

SEQ ID NO: 142324 - RNA, 99 nt, Human
gaggcaggaggaucacuugaguguggaagguugaggcuguagugagccaugauugcaccacugcacuccagccugggcaacagagagacauccuuucuc

SEQ ID NO: 142325 - RNA, 99 nt, Human
gaggcagggaaaucgcuugaacccaggagacagagguuucagugagccgagaucgugccacugcacuccagccugggcaacagagugagacucugucuc

SEQ ID NO: 142326 - RNA, 105 nt, Human
gaggcugagacaggagaauugcuugaacccaggagguggagguuucagugagccaagauuguaccacugcacuccagccugggcaacagagcgagacuccgccuc

SEQ ID NO: 142327 - RNA, 117 nt, Human
gcagucugcgggaccagacuauugugacauggagaauguagagaaauuauucaauguucaggaucaacaugaucuccucacucuaggauggauccauacacaucccacucaaacugc

SEQ ID NO: 142328 - RNA, 72 nt, Human
gcgugaaccugggaggcggagcuugcagugagccgagaucgugccacugcacuccagccugggcaacagagc

SEQ ID NO: 142329 - RNA, 129 nt, Human
gcuacucaggaggcugaggcaggaggaucacuugagccugggaggucuaggcugcagugagccgggacgaugccacugcacuccagccugggcaacagagugagacccugucccagcacucugggaggc

SEQ ID NO: 142330 - RNA, 72 nt, Human
gcucgaacccagaagguggaguuugcagugagccgagaucgugccacugcacuccagccugggcaacacagc

SEQ ID NO: 142331 - RNA, 72 nt, Human
gcuugaacccaggaaguggagguugcagggagccaugaucgcaccacugcacuccagccugggcaacagagc

SEQ ID NO: 142332 - RNA, 73 nt, Human
gcuugaacccaggaggcggagguugcagugagccaagauugcgccacugcacuccagccugggcaacaaaagc

SEQ ID NO: 142333 - RNA, 70 nt, Human
gcuugaacucgggguggagguugcagugagccaagaucgccccacugcacuccagccugggcaacaaugc

SEQ ID NO: 142334 - RNA, 119 nt, Human
ggaauguucugaagaacugggugaucuugugaaaucuguggacccuacauuggcacuuaguguguaccuaagggcuaacgucccaaauaaagucauucagugcuuugcagaaacagguc

SEQ ID NO: 142335 - RNA, 85 nt, Human
ggaccagacuauugugacauggagaauguagagaaauuauucaauguucaggaucaacaugaucuccucacucuaggauggaucc

SEQ ID NO: 142336 - RNA, 88 nt, Human
ggagaaucacuagaaccuggaaggcgaagguugcagugagcggagaucgugccacugcacuccagccugggcaacagagcgauacucc

SEQ ID NO: 142337 - RNA, 88 nt, Human
ggagaaucacuugaacccgggagguggagcuugcagugagcugagaucacgccacugcacuccagccugggcaacagagccagacucc

SEQ ID NO: 142338 - RNA, 88 nt, Human
ggagaaucgcuugaacccagaaggcagagguugcagugagccaagauggugccacugcacuccagccugggcaacagagcgagacucu

SEQ ID NO: 142339 - RNA, 88 nt, Human
ggagaaucgcuugaacccaggaaguggagguugcagggagccaugaucgcaccacugcacuccagccugggcaacagagcaagacucc

SEQ ID NO: 142340 - RNA, 88 nt, Human
ggagaaucgcuugaacccaggagauggagguugcagugagcugagaucacgccacugcacuccagccugggcaacagagugagacucc

SEQ ID NO: 142341 - RNA, 95 nt, Human
ggagaaucgcuugaacccaggagguggagagguugcagggagccgagaucacacacaccacugcacuccagccugggcaacaagagcaaaacucc

SEQ ID NO: 142342 - RNA, 88 nt, Human
ggagaaucgcuugaacccaggagguggagguuguggcgagcugagaucaugccacugcacuccagccugggcaacagagugagacucc

SEQ ID NO: 142343 - RNA, 88 nt, Human
ggagaaucgcuugaaccugggagguggagguuguggugagcugagauugugccacugcacuccagccugggcaacagaucgagacucc

SEQ ID NO: 142344 - RNA, 88 nt, Human
ggagaaucgcuugaacucgggaggggaggcugcagugagccaagaucacacaccacugcacuccagccugggcaacaaagugagaccc

SEQ ID NO: 142345 - RNA, 88 nt, Human
ggagaauggcaugaaccugggagguggagcuugcagugagcccagauugcaacacugcacuccagccugggcaacagagccagacucu

SEQ ID NO: 142346 - RNA, 88 nt, Human
ggagaauggcgugaacccaggagguggagcuugcagugagccgagaucgcgccacugcacuccagccugggcaacagagcaagacucc

SEQ ID NO: 142347 - RNA, 72 nt, Human
ggagaauugccugaacccagcaggcagagguugcaccacugcacuccagccugggcaacagagcaagacucc

SEQ ID NO: 142348 - RNA, 88 nt, Human
ggagaauugcuugaacccaagagguggaggcugcagugagcugagaucaugccacugcacuccagccugggcaacagagcaagacucc

SEQ ID NO: 142349 - RNA, 88 nt, Human
ggagaauugcuugaacccaggaggcagaagcugcagugagccaagauagugccacugcacuccagccugggcaacagagcgagacucc

SEQ ID NO: 142350 - RNA, 89 nt, Human
ggagaauugcuugaacccaggagguggagguugcagugagccgagauugagccacugcacuccagccugggcaacaagagcaaaacucc

SEQ ID NO: 142351 - RNA, 88 nt, Human
ggagaauugcuugaacccaggagguggagguuucagugagccaagauuguaccacugcacuccagccugggcaacagagcgagacucc

SEQ ID NO: 142352 - RNA, 88 nt, Human
ggagaauugcuugaacccuggaggcagagguugcagugagccgagaucgugccacugcacuccagccugggcaacagugcgagacucc

SEQ ID NO: 142353 - RNA, 87 nt, Human
ggagaauugcuugaaccugggaaguggagguugcagugagccgagacugagcacugcacuccagccugggcaacagagugagacucu

SEQ ID NO: 142354 - RNA, 88 nt, Human
ggagaauugcuugaaccugggaggugaagguugcagugagcugagaccaugccacugcacuccagccugggcaacagagcaaaacucc

SEQ ID NO: 142355 - RNA, 88 nt, Human
ggaggaucacuugaaccugggagauggaggucucagugagcugagauugcgucacugcacuccagccugggcaacaaaaugagacucc

SEQ ID NO: 142356 - RNA, 107 nt, Human
ggaggcugagaugggagguucacuugaacccaggagguggaggcuguggugagccaacauccugccacugcacuccagccugggcaacagagccaaacucugacucc

SEQ ID NO: 142357 - RNA, 83 nt, Human
ggaucacuugagcccaggagguugaggcugcagugagccauguuccugccacugcacuccagccugggcaacagagugagacc

SEQ ID NO: 142358 - RNA, 93 nt, Human
ggcaggagaaucaccugaacccggguggcagagguugcagggaggcgagaucgugccacugcacuccagccugggcaacagagugagacuguc

SEQ ID NO: 142359 - RNA, 95 nt, Human
ggcaggagaaucgcuugaaccugggagacagagguugcagugagccaagaucgugucacugcacuccagccugggcaacagagugagacucuguc

SEQ ID NO: 142360 - RNA, 95 nt, Human
ggcaggagaauugcuugaaccugggagguggagguugcagugagccgagaucgcaccacugcacuccagccugggcaacagagugaggcucuguc

SEQ ID NO: 142361 - RNA, 126 nt, Human
ggggaugugacuccugauaugaaauccauugccaaggcugaccuuaucgucacuacgccagagaagugggauggagucagcagaagcuggcaaaauaggaacuauguucagcaagucacuauucuc

SEQ ID NO: 142362 - RNA, 65 nt, Human
gugaacccgggagacggagcuugcagugagcugagaucgugccacugcacuccagccugggcaac

SEQ ID NO: 142363 - RNA, 76 nt, Human
ucacuggaacccaggagguggagguugcagugagucaagauagugccacugcacuccagccugggcaacagaguga

SEQ ID NO: 142364 - RNA, 78 nt, Human
ucacuggaaccugggagguggagguugcagugagcugagacugugccacugcacuccagccugggcaacagagcaaga

SEQ ID NO: 142365 - RNA, 76 nt, Human
ucacuugaacccuggaggcagagguugcagugagccgauaucaugccacugcacuccagccugggcaacacaguga

SEQ ID NO: 142366 - RNA, 76 nt, Human
uccauugccaaggcugaccuuaucgucacuacgccagagaagugggauggagucagcagaagcuggcaaaauagga

SEQ ID NO: 142367 - RNA, 77 nt, Human
ucgcuugaaccccggaggcagagauugcagugagccgagaucaugccacugcacuccagccugggcaacaagagcga

SEQ ID NO: 142368 - RNA, 101 nt, Human
ugagacaaaagaauugcuugaaccugggagguggaaguugcagugagccaagauugugccacugcacuccagccugggcaauaaggcaagacuccgucuca

SEQ ID NO: 142369 - RNA, 101 nt, Human
ugagacaggagaauugcuugaaccuggcaggcggagguuacagugagccaagaugguaccacugcacuccagccugggcaacauagcaacacucugucuca

SEQ ID NO: 142370 - RNA, 98 nt, Human
ugagacaguaucacuugaacccaggggguggagguugcggugagccgagauugugccacugcacuccagccugggcaacagagugagacucuguuuca

SEQ ID NO: 142371 - RNA, 91 nt, Human
ugagaggacugcuugaacucgggguggagguugcagugagccaagaucgccccacugcacuccagccugggcaacaaugcaagaccccuca

SEQ ID NO: 142372 - RNA, 106 nt, Human
ugaggcacaagaauugcuugaaccugggagggggagguuucagugagccgagccgagauugugucacugcacuccagccugggcaacagagugagacucugucuca

SEQ ID NO: 142373 - RNA, 101 nt, Human
ugaggcaggaaaaucacuugaacccuggaggcagagguugcagugagccgauaucaugccacugcacuccagccugggcaacacagugagacucugucuua

SEQ ID NO: 142374 - RNA, 104 nt, Human
ugaggcaggagaaccgcuugaacccaggaggaggaggagguugcagugggccgagaucgagccacugcacuccagccugggcaacagagugagacuccaucuca

SEQ ID NO: 142375 - RNA, 101 nt, Human
ugaggcaggagaauagggugaacccaggagguggagcuugcagugagccgagaucgcgccacugcacuccagccugggcaacagagcgagacuccgucuca

SEQ ID NO: 142376 - RNA, 102 nt, Human
ugaggcaggagaaucacuugaacccaagaggcggagguugcagugagcugagaucgcgccacugcacuccagccugggcaacaagagcaaaacuccgucuca

SEQ ID NO: 142377 - RNA, 101 nt, Human
ugaggcaggagaaucgcuugaacccagaaggcagagguugcagugagccaagauggugccacugcacuccagccugggcaacagagcgagacucuaucuca

SEQ ID NO: 142378 - RNA, 101 nt, Human
ugaggcaggagaaucgcuugaacccgggaggcggagguuguggugagccgagaucucgccacugcacuccagccugggcaacagagugagacuccgucuca

SEQ ID NO: 142379 - RNA, 100 nt, Human
ugaggcaggagaaucgcuugaacccggggggaggagguuacagugagcugagaucgcgccacugcacuccagccugggcaacaagagugaaacugucuca

SEQ ID NO: 142380 - RNA, 99 nt, Human
ugaggcaggagaaucguuugaaccuaggaggcggagguuccagugagcugagauggcgccacugcacuccagccugggcaacagagugagacugucuca

SEQ ID NO: 142381 - RNA, 101 nt, Human
ugaggcaggagaauggccugaaccuaggagguggagcuugcagugagccgagauagcgccacugcacuccagccugggcaacagagcgagacucugucuca

SEQ ID NO: 142382 - RNA, 101 nt, Human
ugaggcaggagaauugcuugaacccaggaggcagaagcugcagugagccaagauagugccacugcacuccagccugggcaacagagcgagacuccgucuca

SEQ ID NO: 142383 - RNA, 102 nt, Human
ugaggcaggagaauugcuugaacccgggagguggagguugcagugagccaagauugcgccacugcacuccagccugggcaacaagagcaaaacucugucuca

SEQ ID NO: 142384 - RNA, 101 nt, Human
ugaggcaggagaauugcuugaaccugggaggcagagguugcagugagcugaaaucgcgccacugcacuccagccugggcaauagggcaagacuccgucuca

SEQ ID NO: 142385 - RNA, 101 nt, Human
ugaggcaggagagucgcuggaaccugagaggcggagcuugcagugagccgagaucgcgccacugcacuccagccugggcaacacagcgagacuccgucuca

SEQ ID NO: 142386 - RNA, 101 nt, Human
ugaggcaggaggauugcuucaacccaggagcuggaggcugcagugagcuaugaucaugccacugcacuccagccugggcaacagaauaauauccugccuca

SEQ ID NO: 142387 - RNA, 101 nt, Human
ugaggcagggaaaucgcuugaacccaggagacagagguuucagugagccgagaucgugccacugcacuccagccugggcaacagagugagacucugucuca

SEQ ID NO: 142388 - RNA, 101 nt, Human
ugaggcgggagaauggcgugaacccaggagguggagcuugcagugagcggagaucuugccacugcacuccagccugggcaacagagcgagacucugucuca

SEQ ID NO: 142389 - RNA, 101 nt, Human
ugagggaggagaauggcaugaaccugggagguggagcuugcagugagcccagauugcaacacugcacuccagccugggcaacagagccagacucugucuca

SEQ ID NO: 142390 - RNA, 100 nt, Human
ugagguacgacaauugcuugaacccaggagguggaggcugcagugagugagaucacaccacugcacuccagccugggcaacagagugagacccuaucuca

SEQ ID NO: 142391 - RNA, 74 nt, Human
ugcuugaacccaaaaggcggagguugcagugagccaagauugugccacugcacuccagccugggcaacagagca

SEQ ID NO: 142392 - RNA, 72 nt, Human
ugcuugaacucgggguggagguugcagugagccaagaucgccccacugcacuccagccugggcaacaaugca

SEQ ID NO: 142393 - RNA, 127 nt, Human
uggaauguucugaagaacugggugaucuugugaaaucuguggacccuacauuggcacuuaguguguaccuaagggcuaacgucccaaauaaagucauucagugcuuugcagaaacaggucaagucca

SEQ ID NO: 142394 - RNA, 100 nt, Human
uggggcaggacgauugcuugagcccaggagcuuaaagcugcaguaaguggugacuugccacugcacuccagccugggcaacaaagcaagacucugucuca

SEQ ID NO: 142395 - RNA, 67 nt, Human
uugaacccuggaggcggagguugcagugagccgagauggcaccacugcacuccagccugggcaacaa

SEQ ID NO: 142396 - RNA, 76 nt, Human
uugcuugaacccaggaggcagagguugcagugagccaagauugugccacugcacuccagccugggcaacagaguga

SEQ ID NO: 142397 - RNA, 76 nt, Human
uugcuugaacccaggagguggagguugcagugagcugagaccaugccauugcacuccagccugggcaacagaguga

SEQ ID NO: 142398 - RNA, 81 nt, Human
uugcuugaaccugggagggggagguuucagugagccgagccgagauugugucacugcacuccagccugggcaacagaguga

SEQ ID NO: 142399 - RNA, 76 nt, Human
uugcuugaaccugggagguggaaguugcagugagccaagauugugccacugcacuccagccugggcaauaaggcaa

SEQ ID NO: 142400 - RNA, 75 nt, Human
uugcuugagcccaggagcuuaaagcugcaguaaguggugacuugccacugcacuccagccugggcaacaaagcaa

SEQ ID NO: 142401 - RNA, 76 nt, Human
uugcuugagccccagaguuugaggcugcagugagcugugaucacaccacugcacuccagccugggcaacagaguga

SEQ ID NO: 142402 - RNA, 68 nt, Human
uuggagcccagaagguugaagcugcagugagcugugaucaugccacugcacuccagccugggcaacag

SEQ ID NO: 142403 - RNA, 80 nt, Human
gguccagauguggccaugggagacugaggggcggacguguuccugggugcuuccuucaucucagucuccucacugagacc

SEQ ID NO: 142404 - RNA, 91 nt, Human
agucaccagaguccauuguauuagucuuauuuucaucaccgugggcguacccugugggaugauguuaaacguacucuagacucuguuggcu

SEQ ID NO: 142405 - RNA, 88 nt, Human
ggagaaucgcuugaacccgagagguggagguugcagugagccaagaucacaucacugcacuccagccugggugacagagcaagacucc

SEQ ID NO: 142406 - RNA, 78 nt, Human
cuuagggcucuuucagguuggcugugcccugcugaaugccagcuggccuagcaccaaccugaucucugccuaccugag

SEQ ID NO: 142407 - RNA, 94 nt, Human
cucugcaaagggcaggaccuguaucuguuuuauucaagucugugacuccaaucccaggcagaaugcaauggcauccagucagcccucaguaaag

SEQ ID NO: 142408 - RNA, 99 nt, Human
ugcuguccucuccggcuuccugucugcucuguucucacaggcacaaggguccccuaccuccgugucuacugcacccagcggacaggaccagcggcagug

SEQ ID NO: 142409 - RNA, 76 nt, Human
ucgcuugaacccaggagguggagguugcagugaaugaagaucgugccacugcacuccagccugggcgauagagcga

SEQ ID NO: 142410 - RNA, 107 nt, Human
cugagcuuagcuaucuuugugguucaauucaccggagucucaaaaccuggcagguguuaucaucuuccugaggcaccgagagucgggacugccagaggccugcacag

SEQ ID NO: 142411 - RNA, 96 nt, Human
ggcugccacuguucccucucugucauucacccucugcuucucaaccuuucgggaaaagcagcauuccugagggcagagggacagaaggugugggcc

SEQ ID NO: 142412 - RNA, 74 nt, Human
ccucucugucauucacccucugcuucucaaccuuucgggaaaagcagcauuccugagggcagagggacagaagg

SEQ ID NO: 142413 - RNA, 85 nt, Human
guguagcaugcaucaguacuucaccuacuguauggauauacuaugcuuuaaaaauccauucauuaggccaggugcgguggcucac

SEQ ID NO: 142414 - RNA, 87 nt, Human
guguagcaugcaucaguacuucaccuacuguauggauauacuaugcuuuaaaaauccauucauuaggccaggugcgguggcucacgc

SEQ ID NO: 142415 - RNA, 88 nt, Human
gcagggauucauggacuagguuugcaccuucugaaccaugagcuagaccaugucuggaggcuggaaccuggugacccaggcucccugc

SEQ ID NO: 142416 - RNA, 88 nt, Human
gccgauugcuggucaaggagccagauauacucuuaagacaugauguggguuuuauggggcucccuggcucugggaguggcagugaggc

SEQ ID NO: 142417 - RNA, 86 nt, Human
gcuguaacacagagcagguuuggaauggcuccacccacagggccacaagaaacaaacccauggagaguuccagaucuguuugcagc

SEQ ID NO: 142418 - RNA, 100 nt, Human
gagucaggagaaucgcuugaacucgggagguggagguuguggugagcuaagaucacaccauugcacuccagccugggcaacaagagcgaaacuccaucuc

SEQ ID NO: 142419 - RNA, 99 nt, Human
ggcuccggugguugcagucagauggcagcuggagguggagcaaccugaugucgugguuuugcauccacgacagcuucucucagacaagugauccuagcc

SEQ ID NO: 142420 - RNA, 71 nt, Human
ccugaggcaggaccuguggaaucugcucuuaaggcucuuaagggagguuugcagucccuaaaugcuucagg

SEQ ID NO: 142421 - RNA, 71 nt, Human; identical to SEQ ID NO: 142420

SEQ ID NO: 142422 - RNA, 72 nt, Human
uaggaaugggaugguuguuuuagguaggcuugggagccaggcugcccugaacucuggccauccacacuucua

SEQ ID NO: 142423 - RNA, 111 nt, Human
acagaacaucagcaugauccuggcagcccauagaccagacguccuugaggucuuagcgccaccgccucccugucuuccucauguaggcugcuuucaugggaaacugauggu

SEQ ID NO: 142424 - RNA, 103 nt, Human
caucagcaugauccuggcagcccauagaccagacguccuugaggucuuagcgccaccgccucccugucuuccucauguaggcugcuuucaugggaaacugaug

SEQ ID NO: 142425 - RNA, 90 nt, Human
gaagaaucgcuugaaucccaaagguggagguugcagugagccgagaucgcgccacugcacuccagccuggcgacagagcaagacuccguc

SEQ ID NO: 142426 - RNA, 113 nt, Human
aguaaugaccaaggaaucaugccaucuggcuugaaguuaugcaccagcucagugugagacuaaacugugcuauggcugccacucaagccaauggggccuuaggcugaauuacu

SEQ ID NO: 142427 - RNA, 73 nt, Human
ccaucuggcuugaaguuaugcaccagcucagugugagacuaaacugugcuauggcugccacucaagccaaugg

SEQ ID NO: 142428 - RNA, 96 nt, Human
cacccgugccugggauucucuaagacaaaggagaagucuuaaagccuuacagcgucuuaagucuuagaucacauuuagagagacccgguacaggug

SEQ ID NO: 142429 - RNA, 81 nt, Human
aggcgcuaaaccuaaggcuuuucugggaagagcuguuaagauuagacuguucucccaaaaagccaauaauucugagugucu

SEQ ID NO: 142430 - RNA, 113 nt, Human
ugguagggaauuagaugucucucagaaucuuuugucucugagaagaugccuagagaaaagggaauucaauaggauaaaagucauucuccagauucacauuuauuuuccuacca

SEQ ID NO: 142431 - RNA, 107 nt, Human
guaaaugucucuaaauuuaucaugcuuguuggcugguguccugcugggccccuucuccuggccagccccagccacaagacacugagacugcagcgugagacagagac

SEQ ID NO: 142432 - RNA, 82 nt, Human
ucauuuugaagauguuuaacaaaucauuuggaacacccuuuggggguggcacagguggcuuuggcacaacuucaacauuugg

SEQ ID NO: 142433 - RNA, 88 nt, Human
uugcuuucuaauuggaguaacuggccuuggaaccuguagucagucauuugccucagguuuaccugccagucccaccagucuaaagcaa

SEQ ID NO: 142434 - RNA, 94 nt, Human
ucaccugcuaaccagguaucuguacucacucagcgugccugcuuggcgaaucucagcugagucaguuacaacagguccccuuucagacagguga

SEQ ID NO: 142435 - RNA, 102 nt, Human
ggugauccacccaccucggccucccaaaguugugggauugcaggcgugagccacugcgccuggccuaauuuuucaauuuuuugguggagauaggguuucacc

SEQ ID NO: 142436 - RNA, 101 nt, Human
auuuguauguaugugcaugguguguaugagugugucgaugugugcuguuuuguacacuuaucugugcacgagcaugcacacccaacucaggacaugcagau

SEQ ID NO: 142437 - RNA, 100 nt, Human
ucucugagccucugcugcuuuucuuguguaacaaaaugaauaauaccugcccugaggggcuauggcagguaaaggagagugcaggcagagguugcagagg

SEQ ID NO: 142438 - RNA, 123 nt, Human
gugaaacaaaggacaucuguagcaaagccuuucaacucuagauuguccucuccauccuagaaauggaggaggaagugauagcugaaguugguuaauuaaaugcucugaucuucuguaaaauac

SEQ ID NO: 142439 - RNA, 82 nt, Human; identical to SEQ ID NO: 140508

SEQ ID NO: 142440 - RNA, 91 nt, Human
cagagucucgcucuguugcucaggcuggagugcaguggugcaaucuuggcucacugcaaccuccaucuccuggguuuaagcgauucucaug

SEQ ID NO: 142441 - RNA, 86 nt, Human
gagucucgcucuguugcucaggcuggagugcaguggugcaaucuuggcucacugcaaccuccaucuccuggguuuaagcgauucuc

SEQ ID NO: 142442 - RNA, 82 nt, Human; identical to SEQ ID NO: 140508

SEQ ID NO: 142443 - RNA, 82 nt, Human; identical to SEQ ID NO: 140508

SEQ ID NO: 142444 - RNA, 129 nt, Human
ucuugaucuuucauuucaacguugaggucuagugcacacagaacuugaaacaccgcacucugucaacagcaauaauccacucaguacugugggauggauggguuaauggaugagaaaacggcaccaaga

SEQ ID NO: 142445 - RNA, 110 nt, Human
auuuguauugguaaaaaagccaguguagugauuuagaauaugggcucuggauucagacugcgugggugugaguuccaguucuaccacuaccugguuggccuugggcaagu

SEQ ID NO: 142446 - RNA, 83 nt, Human
uaggccuuucuucucccaaccuuuucagaucuugccacugggcagcugguuugaugagauugggucgugaucucugagguuua

SEQ ID NO: 142447 - RNA, 87 nt, Human
ucugugguugaaggaauggauggaagugugugagcuagauugcacagauagcaagcagaacauuucuggugaacuuggacacacaga

SEQ ID NO: 142448 - RNA, 85 nt, Human
cugugguugaaggaauggauggaagugugugagcuagauugcacagauagcaagcagaacauuucuggugaacuuggacacacag

SEQ ID NO: 142449 - RNA, 105 nt, Human
cgucuaggugaaaugagcuguguaguccuuuagagccucuggacagaagguaaugcucuuaauccagugauucucgagggcagaauggaggauuugcacuagaug

SEQ ID NO: 142450 - RNA, 82 nt, Human; identical to SEQ ID NO: 140508

SEQ ID NO: 142451 - RNA, 95 nt, Human
gggugccuggaagcuacugcuucuucuagucaaauggaaaucuuucaaugaugccagguggugcuguuaagaagcagaauucuuccccuaagccc

SEQ ID NO: 142452 - RNA, 74 nt, Human
guagagauggaguuuuacuauguugcccagguugaucuugaacuccugggcucaagugauccucccaucuugac

SEQ ID NO: 142453 - RNA, 95 nt, Human
aaggggaggugaauguuauuagguccaaccugaaaggugcauauuucaggcagauagauagguguuuggcaucuuauaacugcucacuuuccuuu

SEQ ID NO: 142454 - RNA, 100 nt, Human
uucaaacagccugggaagggacugugcugauaauuggcucugcuuucaaagaacacuuaggagauaauuaacccacaguccaccaagcccaggaauugag

SEQ ID NO: 142455 - RNA, 104 nt, Human
ugagauggaguuuugcucuuguugcccaggcuguaguguaauguagugcaaucuuggcuuaguacaaccucugccuccuggguucaagccauucuccugccuca

SEQ ID NO: 142456 - RNA, 102 nt, Human
gagauggaguuuugcucuuguugcccaggcuguaguguaauguagugcaaucuuggcuuaguacaaccucugccuccuggguucaagccauucuccugccuc

SEQ ID NO: 142457 - RNA, 96 nt, Human
ggugacaagagucucacucugugguccagacuggaguauagugcuaucagagcuuacuacaacuuuaaacuucugggcucaggugauccucccacc

SEQ ID NO: 142458 - RNA, 73 nt, Human
ucacucugugguccagacuggaguauagugcuaucagagcuuacuacaacuuuaaacuucugggcucagguga

SEQ ID NO: 142459 - RNA, 77 nt, Human
agggaggggugugaggaagucccacugaugcuuguguagugcaaguuuccuaggugacuccuuccuuucucuucccu

SEQ ID NO: 142460 - RNA, 82 nt, Human
gcuuugucucccauucccagcaaaggaauuccaggcugugggaagcaugcugggauccuuugaugcgggcggggacaauggc

SEQ ID NO: 142461 - RNA, 97 nt, Human
aggcgugagaaucgcuugaaccuggaagguggugguugcagugagccgagauccugccacugcacuccagccugggcaaccaagcgagacucugccu

SEQ ID NO: 142462 - RNA, 106 nt, Human
gagacgugagaaucguuugaaccugggagguggagguuguagugagcccaaaucaugccacaugucacugcacuccagccuaggcaacagagcaagacucugucuc

SEQ ID NO: 142463 - RNA, 87 nt, Human
ucucuguugguguccuaagguuuauuacaccuuucuaccucagcagggcagcacaauguaguaagauuuaggaugugccagggggga

SEQ ID NO: 142464 - RNA, 103 nt, Human
aggcuuuagaguagcaaaggccccagggaaugggcucuguugggacagcuugucuuugguuuccaguaguuacuccucccugaaggggucaagguugcuuccu

SEQ ID NO: 142465 - RNA, 92 nt, Human
gaguagcaaaggccccagggaaugggcucuguugggacagcuugucuuugguuuccaguaguuacuccucccugaaggggucaagguugcuu

SEQ ID NO: 142466 - RNA, 57 nt, Human
agcagcacagaaauauuggcacagggaagcgagucugccaauauuggcugugcugcu

SEQ ID NO: 142467 - RNA, 74 nt, Human
guccuggaagacaugguagagcugaaggaucagccaacuuugagacucagcucuagcugccugucuccaguggc

SEQ ID NO: 142468 - RNA, 91 nt, Human
ugcagaucucuguuggaaagauggcuuucacaccgauggaaauugucucaucaguaacuuccauccaaaggcuauuuuuccacuuuuugca

SEQ ID NO: 142469 - RNA, 97 nt, Human
gaggcaggagaauugcuucaaacugggcagagguugcagugagccaagguugacccacugcacuccagccugggcaacaagagcaaaacuccaucuc

SEQ ID NO: 142470 - RNA, 82 nt, Human
ucuuuuuggcuugggacccaggggguuuucucucccucugagucaucgaugagaccguaacccccaguccccagcccuagga

SEQ ID NO: 142471 - RNA, 82 nt, Human
ggagaaucgcuugaauccaggagguugcagugagcugagaucacgccacugcacuccagccugggugacagagcaagacucc

SEQ ID NO: 142472 - RNA, 74 nt, Human
agaaggagaagagaucuuaggucucuucguuccugucuauagaacagagacuuaagauccugccucuuccuucu

SEQ ID NO: 142473 - RNA, 102 nt, Human
ugagacaggagaaucgcuugaacccgggaggcagagguugcagugagaugagaucacaccacugcacuccagccugggcaacaagagcgaaacuccaucuca

SEQ ID NO: 142474 - RNA, 100 nt, Human
gagacaggagaaucgcuugaacccgggaggcagagguugcagugagaugagaucacaccacugcacuccagccugggcaacaagagcgaaacuccaucuc

SEQ ID NO: 142475 - RNA, 89 nt, Human
ggagaaucgcuugaacccgggaggcagagguugcagugagaugagaucacaccacugcacuccagccugggcaacaagagcgaaacucc

SEQ ID NO: 142476 - RNA, 69 nt, Human
cuugaacccgggaagcagagguugcagugagccgacaucgugccacugcacuccagccugggcaacaag

SEQ ID NO: 142477 - RNA, 79 nt, Human
ucuccaacaguggcugccuggggaaugugaggauugucccaaagcacaaucacuggcuccucacggcaaggccaugaga

SEQ ID NO: 142478 - RNA, 101 nt, Human
ugaggcaggagaauugccugaacucaggaagcggaggucgcaguaagcugagaucaugccacugcacuccagccugggcaacagagcgagacucugucuca

SEQ ID NO: 142479 - RNA, 88 nt, Human
ggagaauugccugaacucaggaagcggaggucgcaguaagcugagaucaugccacugcacuccagccugggcaacagagcgagacucu

SEQ ID NO: 142480 - RNA, 82 nt, Human; identical to SEQ ID NO: 140508

SEQ ID NO: 142481 - RNA, 84 nt, Human
agaaucacuugaacgugggaggcagaggcugcagugagccgagaucgugccacugcacuccagccugggcaacagagugagacu

SEQ ID NO: 142482 - RNA, 106 nt, Human
cuucaccugaacucacuggggcuucuccagggauauuaaccuggacuuuaagagucagagugagucccugggacuaguucagcccauccaggauucagacgggaag

SEQ ID NO: 142483 - RNA, 95 nt, Human
ggcaugagaaucgcuugaacccgggaggcggaggcugcagugagccaagaucgugccacugcacuccagccugggcaaccgagugagacucuguc

SEQ ID NO: 142484 - RNA, 113 nt, Human
agauguauuaugucuguccuugcggggguucuggucccugugucagucuuaacucucaugaauauagagguaguguuaagaggccagaacccuagggacgcuuuaaauucacu

SEQ ID NO: 142485 - RNA, 91 nt, Human
gcugaguccccaggucaauggaacucccucuaggaacuacccugcuacaagcaugguuucaggauugaguuccccaaggaccaggaccagu

SEQ ID NO: 142486 - RNA, 82 nt, Human
guccccaggucaauggaacucccucuaggaacuacccugcuacaagcaugguuucaggauugaguuccccaaggaccaggac

SEQ ID NO: 142487 - RNA, 94 nt, Human
guuaccuuccucugccucugcucccuugucuagggcguggagaugagguguccuuccuauucacaggguugcugcgaggacagagugaguuggc

SEQ ID NO: 142488 - RNA, 82 nt, Human; identical to SEQ ID NO: 140508

SEQ ID NO: 142489 - RNA, 111 nt, Human
cuggcauacaagagcccggaacuucugccgauuugucacugcaaucaacaauacuccccggaacaucggcaaggauggcaaguuucagaugcuggugugcuugggagccag

SEQ ID NO: 142490 - RNA, 71 nt, Human
cugcuugaacccaggaggcagagauugcagugagucaagauggcacuacugcacuccagccugggcaacag

SEQ ID NO: 142491 - RNA, 80 nt, Human
agcaggcuaacuaggaguugacaagcuaagaaagugaaacuguucuuucuuaguuaacugucuuucucuggagcucuguu

SEQ ID NO: 142492 - RNA, 102 nt, Human
ugaggcaggagaauugcuugaacccgggagguggagguugcggugagccgaggucgcgccauugcacuccagccugggcaacaagagcgaaacuccgucuca

SEQ ID NO: 142493 - RNA, 100 nt, Human
gaggcaggagaauugcuugaacccgggagguggagguugcggugagccgaggucgcgccauugcacuccagccugggcaacaagagcgaaacuccgucuc

SEQ ID NO: 142494 - RNA, 102 nt, Human
ugaggcaggagaaucgcuugaacccaggagguggagguugcagugagccgagaucgcgccauugcacuccagccugggcaacaagagcagaacuccgucuca

SEQ ID NO: 142495 - RNA, 89 nt, Human
ggagaaucgcuugaacccaggagguggagguugcagugagccgagaucgcgccauugcacuccagccugggcaacaagagcagaacucc

SEQ ID NO: 142496 - RNA, 113 nt, Human
gugugauauagguggucugggaucauggcuggacaaacacaaugcaguaggaagagugcuggcucuuggucacugcugugugacccaaugaucuugagcaucacccgucauac

SEQ ID NO: 142497 - RNA, 100 nt, Human
gaggcaggagaauugcuugaaccugguggggcagagguugcagugagccgagauaacgcuacugcacuccagccugggcaacagaguaaaacuccgucuc

SEQ ID NO: 142498 - RNA, 98 nt, Human
gaggcaggagaaucguuugaaccugggaagcggagguugccgugagucgagaucaugccauugcacuccagccugggcaacaagagcgaaacucucuc

SEQ ID NO: 142499 - RNA, 84 nt, Human
agaauugcucgaacccgggagacagagguugcagugagccgagauugugccacugcacuccagccugggcaacagagcgagacu

SEQ ID NO: 142500 - RNA, 76 nt, Human
uugcucgaacccgggagacagagguugcagugagccgagauugugccacugcacuccagccugggcaacagagcga

SEQ ID NO: 142501 - RNA, 72 nt, Human
gcucgaacccgggagacagagguugcagugagccgagauugugccacugcacuccagccugggcaacagagc

SEQ ID NO: 142502 - RNA, 96 nt, Human
gggcgaguccuuaaccuuggcaaaauaaacuucugaauuuauugagaccugucucagguacuuuuugguuuacaugugcuugugagggcaggcacc

SEQ ID NO: 142503 - RNA, 108 nt, Human
ggaagcauuuaaggaaaaggcuuguuuuucauuucaggggagguuuaggccaagagagugguugaguaaacacacugcugugagagaaugccugguacuuaaaugccc

SEQ ID NO: 142504 - RNA, 102 nt, Human
gcauuuaaggaaaaggcuuguuuuucauuucaggggagguuuaggccaagagagugguugaguaaacacacugcugugagagaaugccugguacuuaaaugc

SEQ ID NO: 142505 - RNA, 80 nt, Human
agagaugcuaaguuuagauuccagggggcaggacuggauuuuuaauuucaucuggcuccugaguccuagcuccuaauccu

SEQ ID NO: 142506 - RNA, 82 nt, Human; identical to SEQ ID NO: 140508

SEQ ID NO: 142507 - RNA, 82 nt, Human
ugaauuugugacuugucugguuuggcaucucgaagggcuuucucuacuggguccagggugccacagaacaggucagcauuca

SEQ ID NO: 142508 - RNA, 100 nt, Human
gaggcaggagaaucgcuugaaucuaggaaucagagguugcagugagccaaggucacaccacuugcacuccacagccugggugacagagugagacugccuc

SEQ ID NO: 142509 - RNA, 91 nt, Human
uucaucauagaaauggaacugccgggucaaggauauguauguuuauauggacauaugugaauuuucuuccuggcaucccuuccuuugggaa

SEQ ID NO: 142510 - RNA, 82 nt, Human; identical to SEQ ID NO: 140508

SEQ ID NO: 142511 - RNA, 99 nt, Human
gaggcaggagaauggcgcgaacccgggaaguggagcuugcagugagccgagaucgcgccacugcacuccagccugggcaacagagcgaaacuccgucuc

SEQ ID NO: 142512 - RNA, 101 nt, Human
ugagacaggagaaucacuugaacuccggagguugagguuucagugggccgagaccgagcgacugcacuccagccugggcaacagagcgagacuccauuuca

SEQ ID NO: 142513 - RNA, 96 nt, Human
gaacaucucaagcacuucaggcaauucacauuccuucagcaaauauuuguugagcaccuggagugugccugagauucuuucagguguugggaauuc

SEQ ID NO: 142514 - RNA, 87 nt, Human
aacaucucaagcacuucaggcaauucacauuccuucagcaaauauuuguugagcaccuggagugugccugagauucuuucagguguu

SEQ ID NO: 142515 - RNA, 76 nt, Human
uccugcauggcaguuccauaugcagagccagaauccauccuuguuccuucugcauugugagaaaauccauggagga

SEQ ID NO: 142516 - RNA, 86 nt, Human
gggaaagagagggaugaaguaaaaacaucugggaggucagacaaauggccgugcaguuuccuaauuccaucaugcuucuccuuccc

SEQ ID NO: 142517 - RNA, 101 nt, Human
ugaaccccggagacagagguugcagugagccgagauacauacauauauauguauauaucaugugcaacuuggcucugcuccuuuguaaguuugugggcuua

SEQ ID NO: 142518 - RNA, 74 nt, Human
acagagguugcagugagccgagauacauacauauauauguauauaucaugugcaacuuggcucugcuccuuugu

SEQ ID NO: 142519 - RNA, 88 nt, Human
ggagaauugcuugaacccaggaggcggagguugcagugagccgagauagcaccacugcacuccagccugggcaacagagugagacucc

SEQ ID NO: 142520 - RNA, 80 nt, Human
ccugacucugaucacaggcaaaggaauaaagucucauuucaauccugagcuucuccuaauucuuguggaucagagcuggg

SEQ ID NO: 142521 - RNA, 83 nt, Human
agcagacugaacuaagacacccucugccugugguugucuuggcaaagccagguaaugcaggagagggguggacucagccugcu

SEQ ID NO: 142522 - RNA, 76 nt, Human
uugcuuuagcccaggaauucgaguuugcagugagcuaugauggugucauugcacuccagccugggcaaucaagcaa

SEQ ID NO: 142523 - RNA, 111 nt, Human
cagcugggacugcaggggcacaacaucacgccuggcuaauuuuuguauuuucuguagggcuaggauuucacaguguuacccaggcuggucucaaaauccugggcucaaaug

SEQ ID NO: 142524 - RNA, 81 nt, Human
uggugaagagagucauggagucagacaugcuggacuucuggcucuaaccuugcuagcugugugacuuugaccucuuugaca

SEQ ID NO: 142525 - RNA, 86 nt, Human
ggugaagagagucauggagucagacaugcuggacuucuggcucuaaccuugcuagcugugugacuuugaccucuuugacauucauc

SEQ ID NO: 142526 - RNA, 109 nt, Human
cugugacuauuucgcugaaucuuugcaacucugagaggucaguacuuuuauuuuacccauuuuguaggugagaaaacugaggcucagaaaggguaacacagugacacag

SEQ ID NO: 142527 - RNA, 102 nt, Human
cugccuccccacucaagcucuguaaggacgcaaagagggcaaggccacgaaggacucagccuggcccaucgugucccugcucugccccagugccagagccag

SEQ ID NO: 142528 - RNA, 90 nt, Human
ggggcuggccgccucagugauggugaugccaccagcuccagccugcacggauggagcucacuuccuaccaucacuucugcuuucagucuc

SEQ ID NO: 142529 - RNA, 83 nt, Human
cuccuugauugaggcuaguagguuuuuaagaccugaauaauugaguuugcagaaaccuacugugugccuucagguaaauggag

SEQ ID NO: 142530 - RNA, 75 nt, Human
cuuucucucgugaauggagcuguuuucuucagagccuuugcucugaaacaucacgcuccccuguauggggagaag

SEQ ID NO: 142531 - RNA, 102 nt, Human
ugaggcaggagaaucgcuugaacccgggaggcggaggucguggugagccaaaaucgcaccauugcacuccagccugggcaacaagagugaaacucugucuca

SEQ ID NO: 142532 - RNA, 100 nt, Human
gaggcaggagaaucgcuugaacccgggaggcggaggucguggugagccaaaaucgcaccauugcacuccagccugggcaacaagagugaaacucugucuc

SEQ ID NO: 142533 - RNA, 131 nt, Human
augcauggggguacacaggggacacaaugcaguguuggugggaaauagucauugagcacuucuccuuuccucucaugugaaauguucagagaaucaccaccagacacucccgugugaaaauuuguaugcau

SEQ ID NO: 142534 - RNA, 85 nt, Human
cugggauuacaugugugagccaccgcgccuggccucaaauuguuuuugaaguaguuagguuguagcucauaagacugucuuucag

SEQ ID NO: 142535 - RNA, 58 nt, Human
ugugagccaccgcgccuggccucaaauuguuuuugaaguaguuagguuguagcucaua

SEQ ID NO: 142536 - RNA, 82 nt, Human; identical to SEQ ID NO: 140508

SEQ ID NO: 142537 - RNA, 98 nt, Human
ccccuuccuagcguguaggugugcacuuugacccugcuguaguguguaaguaugcucacugaccucugcccuacuguauauccugacacaggaagggg

SEQ ID NO: 142538 - RNA, 84 nt, Human
cugggaugggauggagcaagaggugaagaucuuggagucuggaaucagaccaccuggauuuucauccuaguuccccgaucuggg

SEQ ID NO: 142539 - RNA, 76 nt, Human
gaugggauggagcaagaggugaagaucuuggagucuggaaucagaccaccuggauuuucauccuaguuccccgauc

SEQ ID NO: 142540 - RNA, 88 nt, Human
ggagaaucacuugaacucgagaggcggagguugcagugagcugagaucccgccacugcacuccagccugggugacagagcgagacucc

SEQ ID NO: 142541 - RNA, 85 nt, Human
cuacagagauaaaggacggugacucuugugucaguuaguuguugucacaaaaugcugcauaacaagucacuccaaaucucagugg

SEQ ID NO: 142542 - RNA, 99 nt, Human
uuguugauucuguugaggauauaucccuaugaugucccugggaagcgauggggcauucccagucaucugggaugugcaguuucuaaauauuaucaaugg

SEQ ID NO: 142543 - RNA, 89 nt, Human
gauucuguugaggauauaucccuaugaugucccugggaagcgauggggcauucccagucaucugggaugugcaguuucuaaauauuauc

SEQ ID NO: 142544 - RNA, 92 nt, Human
acaaaugucuuuggccucugugccuuuccucagacuuucaggcccauugugagagagcuaggaagauacaggguugucaaguugacacaugu

SEQ ID NO: 142545 - RNA, 79 nt, Human
uugcuugaaccuuggaggcagagguugcagugagccaagaucaugccacugcacuguagccuccugggugacagaguga

SEQ ID NO: 142546 - RNA, 114 nt, Human
guuccucuucucauuggcugaugugcucuguggcaucugucacagguuuuaauugaaggucagcaguggcagguaagccaccagcaucaucagcuucuuucagccuuuuggaac

SEQ ID NO: 142547 - RNA, 80 nt, Human
ggcugaugugcucuguggcaucugucacagguuuuaauugaaggucagcaguggcagguaagccaccagcaucaucagcu

SEQ ID NO: 142548 - RNA, 101 nt, Human
ugaggcagaagaaucucuuaaacccgggaggcggagguugcagugagccgagauugcgucacugcacuccagccugggcaacagagcgagacuccguuuca

SEQ ID NO: 142549 - RNA, 93 nt, Human
gaagaaucucuuaaacccgggaggcggagguugcagugagccgagauugcgucacugcacuccagccugggcaacagagcgagacuccguuuc

SEQ ID NO: 142550 - RNA, 72 nt, Human
cucuuaaacccgggaggcggagguugcagugagccgagauugcgucacugcacuccagccugggcaacagag

SEQ ID NO: 142551 - RNA, 93 nt, Human
ucuuucacuggaaucacaucugcagcuccucccccuccgcccucccucaggcuuagaccguggagcuguaacagaucuguucuucgugugaga

SEQ ID NO: 142552 - RNA, 103 nt, Human
cugccagccgucugucucuaguguuuuuccaaaugacauccagggcucuggccguggagucccugaugugaucgcuaaaggaccuccggagaggggcucgcag

SEQ ID NO: 142553 - RNA, 88 nt, Human
gucugucucuaguguuuuuccaaaugacauccagggcucuggccguggagucccugaugugaucgcuaaaggaccuccggagaggggc

SEQ ID NO: 142554 - RNA, 104 nt, Human
gcacuauucacaguaucagagacauggaucaauccaccguugaucaccgguggauuggaugaagaaaugguggauugguacauguauaucauggaauacugugc

SEQ ID NO: 142555 - RNA, 102 nt, Human
gcguuccugggaaaaccauuuagauuucauucuccuuccuuucucugacagaagcugcuggugaggaagguaaugaucuugaucaaaccauccccagaaugc

SEQ ID NO: 142556 - RNA, 97 nt, Human
aaugcaggaaucacagggacagucaucguuuuaaaagaagcaggaccccgguaucuugcccuuugaaaacagaugaugguggacuuuguuuugcauu

SEQ ID NO: 142557 - RNA, 117 nt, Human
cauuuuaguaaugcucagcuggaccaguguuaguuauauuugagucagaaaaauguuguuuuucaacuugcuuuauaaucuccugcaucuaucuccugcuguagcaucacgaaggug

SEQ ID NO: 142558 - RNA, 82 nt, Human; identical to SEQ ID NO: 140508

SEQ ID NO: 142559 - RNA, 102 nt, Human
uaauucucaaugaagaaauucacugagggagugagguucuucucaaacauuuuuagggcugagaaacucacuuccugcagcuggagauucuuccuuguguug

SEQ ID NO: 142560 - RNA, 90 nt, Human
caaugaagaaauucacugagggagugagguucuucucaaacauuuuuagggcugagaaacucacuuccugcagcuggagauucuuccuug

SEQ ID NO: 142561 - RNA, 71 nt, Human
cuugccaugcagcccuuuuuauggagcaagucacaauacagcagcuugcuucauuagggcaagcaagcaag

SEQ ID NO: 142562 - RNA, 110 nt, Human
ggugaaacugcccuuuccuuucuguucuaugagugugaugguguuugagaaaauguggggcuaugguucaggcgcacuucacaugugcaaagauggagaaagcacucacc

SEQ ID NO: 142563 - RNA, 64 nt, Human
uggguacuuuaucucacacucugauuucuugcuucgugggaaacagacuguaauauuguaagca

SEQ ID NO: 142564 - RNA, 86 nt, Human
ugugcauuccuuccagagcauuugugaggaguguucagcugcugcaaacaucccaugaauccucagcuacuuggaacagguguaca

SEQ ID NO: 142565 - RNA, 92 nt, Human
gggaggacugcuugagcccaggagguggagucuguagugagcugugauccugccacugcacuccagccugggcaacagagcaagacccugcc

SEQ ID NO: 142566 - RNA, 95 nt, Human
ggugggaggacugcuugagcccaggagguggagucuguagugagcugugauccugccacugcacuccagccugggcaacagagcaagacccugcc

SEQ ID NO: 142567 - RNA, 83 nt, Human
ggacugcuugagcccaggagguggagucuguagugagcugugauccugccacugcacuccagccugggcaacagagcaagacc

SEQ ID NO: 142568 - RNA, 111 nt, Human
gagaguguccuguccuccguuguuaaucccagucaagaucaucugagaguuggucuccagggaaccucagaucucuaggauguugcacuggaaauggcugcaggaucuuuc

SEQ ID NO: 142569 - RNA, 100 nt, Human
guccuguccuccguuguuaaucccagucaagaucaucugagaguuggucuccagggaaccucagaucucuaggauguugcacuggaaauggcugcaggau

SEQ ID NO: 142570 - RNA, 105 nt, Human
ccugagacagaguuugcucuuguugcccaggcuggaguuuaauggcacgaucuuggcuuaccacaaccucugccuccuggguucaagcaauucuccugccucagg

SEQ ID NO: 142571 - RNA, 99 nt, Human
gaggcaggagaaucacuugaacccgggagauggagguugcagugagccgagauggcgcaacugcacuccagccugggcaacaaauggagacucugucuc

SEQ ID NO: 142572 - RNA, 109 nt, Human
aggaagaggcuggcuguguggaugagagcaacuugcuuuuuacaauaauuauuuguuauuguaaauuaacaauuugcucuucugguauuauauggaaguauuugauccu

SEQ ID NO: 142573 - RNA, 92 nt, Human
ccacccuugaaaguacauguucuuccucugagcucaggggaggccccgugaauacauagaggagggaagcgugugucuuucuagacaggugg

SEQ ID NO: 142574 - RNA, 79 nt, Human
cuugaaaguacauguucuuccucugagcucaggggaggccccgugaauacauagaggagggaagcgugugucuuucuag

SEQ ID NO: 142575 - RNA, 110 nt, Human
ucugauaaaguucauauaauacagugucaaugacugaauccaggugguggccuuaaagguguucaccguacaauucugucaacuuugcuguguacuuggaauuuuacaga

SEQ ID NO: 142576 - RNA, 129 nt, Human
auuguggaugcgugcaccugcgcuuccugucgagaacauucauuaugcaaaagucaggaaaggagaaacagaacugucauuuggauugugaaaguauucucuggggagcugcccuacuguaucuauaau

SEQ ID NO: 142577 - RNA, 110 nt, Human
cagugacauaucuugcucaguaguuucuuauuccugaagaaccacaagcauaaagugaggccucagugcuggugcucuuggaguauggggaaugugcaaauauuuaacug

SEQ ID NO: 142578 - RNA, 82 nt, Human; identical to SEQ ID NO: 140508

SEQ ID NO: 142579 - RNA, 76 nt, Human
uggaaugcauaagaaauugcaaacugguagcaggcagcaacguuuguuuuggucuguaguuuuguuuugcuuuuca

SEQ ID NO: 142580 - RNA, 87 nt, Human
gagaauugcuugaaccugggagguggagguuguggugagccgaaauugugccauugcacuccagccugggcaacaagagcgaaacuc

SEQ ID NO: 142581 - RNA, 82 nt, Human
ggggagaauucuauagacagaaggucaauguuguccccauccauagggguugaauuaccuugcuguuaaguggucuuccccc

SEQ ID NO: 142582 - RNA, 93 nt, Human
gaguagcugggauuacaggugugugccaccaugucuggcugauuuuuguauuuuuaguagaggugggguuucaccauguuggccaggcugguc

SEQ ID NO: 142583 - RNA, 75 nt, Human
guuggugcaaaagucagugcgguuuuugcuauuaaaaguaacggcaaaaguaacugcacugacuucugcaccgac

SEQ ID NO: 142584 - RNA, 82 nt, Human; identical to SEQ ID NO: 140508

SEQ ID NO: 142585 - RNA, 113 nt, Human
ggauuauaggauuccauugaguaagcuuugaaaugaggacacuaagaucagggggccagcccugagaucagauuuccuuauuuaucuacauugcuuagugcagucagugauuc

SEQ ID NO: 142586 - RNA, 80 nt, Human
guguucgagcacacaccuccuugcaguggcuucagcacccaggucuccgggagccagugaaggaaccaaguguuggauac

SEQ ID NO: 142587 - RNA, 86 nt, Human
ggaccuggagugcaucaggaucugaccagauaggaguuuuugccucgugucugggugcuacgauuuugugccguucucugaggucc

SEQ ID NO: 142588 - RNA, 114 nt, Human
ggccuccucccagcgucacggaaugcuguccugaucccuagcauuuacucacaugcugugcuuagugcuugaccaugugguggcagauucugugauguguaagacgugguugcc

SEQ ID NO: 142589 - RNA, 97 nt, Human
cucccagcgucacggaaugcuguccugaucccuagcauuuacucacaugcugugcuuagugcuugaccaugugguggcagauucugugauguguaag

SEQ ID NO: 142590 - RNA, 86 nt, Human
gcgucacggaaugcuguccugaucccuagcauuuacucacaugcugugcuuagugcuugaccaugugguggcagauucugugaugu

SEQ ID NO: 142591 - RNA, 84 nt, Human
cgucacggaaugcuguccugaucccuagcauuuacucacaugcugugcuuagugcuugaccaugugguggcagauucugugaug

SEQ ID NO: 142592 - RNA, 75 nt, Human
gagaacuguagugcaagguuuugccaacuuuuugaccagaauccucggugaguaauaaauuuugcacugcagcuc

SEQ ID NO: 142593 - RNA, 99 nt, Human
uagcugcacaacacaagcccacaggcaaacacacagacuccugcagugucuagagcagucacugggauaugaagacuguguguggaggcugggcagcua

SEQ ID NO: 142594 - RNA, 100 nt, Human
gaccacaagacugucuccagcuuuuucuagaacagaugcugcugcaccaggaagcaagguauugcagugucagaacugaggauucugggacagccagguc

SEQ ID NO: 142595 - RNA, 83 nt, Human
cugucuccagcuuuuucuagaacagaugcugcugcaccaggaagcaagguauugcagugucagaacugaggauucugggacag

SEQ ID NO: 142596 - RNA, 72 nt, Human
gugggugaauagcgagagggcccucugagcuuuggucugaaaggccaggagggaccaggcgcugucgcucac

SEQ ID NO: 142597 - RNA, 80 nt, Human
uuggggguuguuacaugcaugaugcugagguuugggaauauggauggucccaucacccaggugauguauguaguacccaa

SEQ ID NO: 142598 - RNA, 74 nt, Human
ggguuguuacaugcaugaugcugagguuugggaauauggauggucccaucacccaggugauguauguaguaccc

SEQ ID NO: 142599 - RNA, 90 nt, Human
ggcaggaaaauuccuucaccugggagguggagguugcagugagccaagauugcaccacuacacuccuaggcaauggagugagaccuuguc

SEQ ID NO: 142600 - RNA, 90 nt, Human
gcucuuuaagaaguaagcagaacuguuuuguuuucugugcugcuuagugcaggacaauauagagcagaucuggcucugccccuuagcagc

SEQ ID NO: 142601 - RNA, 91 nt, Human
ggccauauuggauuguguugaaaugugcaucuauacugagauaagggugagagccccuguccacugucagcacagucacuacuagaaggcc

SEQ ID NO: 142602 - RNA, 97 nt, Human
gccuuuuggccauauuggauuguguugaaaugugcaucuauacugagauaagggugagagccccuguccacugucagcacagucacuacuagaaggc

SEQ ID NO: 142603 - RNA, 73 nt, Human
cucagagggcuuggucaccucugccaugaggcuggacugcagcugugguggcaagugaccagaugucacugag

SEQ ID NO: 142604 - RNA, 109 nt, Human
guagaaagcuggaguaugaggaugauauguuuccuuuggcaaaucugugacauggaaauuaccaugagccaaggagccagaggacauagcuuguagcucugcugccugc

SEQ ID NO: 142605 - RNA, 130 nt, Human
agaaaaauuaguuaauauuuaaaaaacuguauugugcauuuuggcuucacauguuuaacuuuuuuuaagaaaaaaguugcaugaauggaaaaaaaaucuguauacaguaucuguaaaaacugucuuaucu

SEQ ID NO: 142606 - RNA, 93 nt, Human; identical to SEQ ID NO: 142582

SEQ ID NO: 142607 - RNA, 82 nt, Human; identical to SEQ ID NO: 140589

SEQ ID NO: 142608 - RNA, 114 nt, Human
cucuguaguuaugugcggucuuacacuauuuuacauggucacuaucagcuuaguuguuugucacuuguuggugacugcuguaagguagauuugagauguccagggacugcagag

SEQ ID NO: 142609 - RNA, 114 nt, Human
gcccuaaacgaagggggccucaaguuacgacuucucaaggcagugacaucuuccucaauugguaugaguagcugccaggcaacaaguacguauaagagugucccauauucuggc

SEQ ID NO: 142610 - RNA, 91 nt, Human
ggggccucaaguuacgacuucucaaggcagugacaucuuccucaauugguaugaguagcugccaggcaacaaguacguauaagaguguccc

SEQ ID NO: 142611 - RNA, 86 nt, Human
ugcaccuucccugggacaacuuucuuauugaugggucuuguguuuaauuaaugagaguuuguuuuagggguaugggcccaggugca

SEQ ID NO: 142612 - RNA, 100 nt, Human
ugaggcaggagaaggcgugaacccaggaggcggagcuugcagugagcagagaucgugccacugcacuccagccugggcaacagagcgagacuccgucuca

SEQ ID NO: 142613 - RNA, 60 nt, Human
gauguguucaagaaaauuuauugcagcauuguuugcaauagugaaaaaacugaacucauc

SEQ ID NO: 142614 - RNA, 77 nt, Human
gccuuggcuucccaaagugcuaggaauacaggugugagccaacaugccuguccuguaaguauuuuuuaaaacaaggc

SEQ ID NO: 142615 - RNA, 106 nt, Human
gucguccauaauauugcuaaugaccagccuuaaacuagacaaccacugaagaaccuggccuaugagcugagaaacuuggguucuuuuauggcuggccauuaacgac

SEQ ID NO: 142616 - RNA, 93 nt, Human
ggagaaucacuugaacccaggaguuagagguugcagugagcccaaaaucacaccacuguacuccagccugccuggguaauagagugagauucc

SEQ ID NO: 142617 - RNA, 111 nt, Human
ggguugauugaucuuaugacguuuauuucuuaucaucacuauuagguaaccagauaaaccuaaugguuagauggaugagaugugaaguuguggcagaugcuaucagugccc

SEQ ID NO: 142618 - RNA, 109 nt, Human
accuugcugacagugguaauuguagugugaaaggcauaguguccucuugcuuaaucaugggauacagacugcucacuucuuaaaugguuaccuuugcaguuuaagaggu

SEQ ID NO: 142619 - RNA, 87 nt, Human
gccuugcagugaaggaggcaugugaucaccaucaaagucuucugcucugggaaggaucacacagucguccuucagccugccuggggc

SEQ ID NO: 142620 - RNA, 120 nt, Human
ggugucugccugguugaucuugaaugauggcaagugggcacuuuucagguaacuauugaugauuaacugacaaagaucugugaaggcuacacuuugucacuucagagugccagagauacc

SEQ ID NO: 142621 - RNA, 129 nt, Human
cauuagaagaaguagugaaauaaagauacuaaagauccagacucagugcacuucaaacuuuuugaaauagcuauucuaacagaugugaggugacaucucauucugguuuuaauuugcauuucucugaug

SEQ ID NO: 142622 - DNA, 22 bp, Human
tagcttatcagactgatgttga

SEQ ID NO: 142623 - DNA, 22 bp, Human
ttcacagtggctaagttctgca

SEQ ID NO: 142624 - DNA, 22 bp, Human
aaagaattctccttttgggctt

SEQ ID NO: 142625 - DNA, 22 bp, Human
aagtgctgttcgtgcaggtagt

SEQ ID NO: 142626 - DNA, 22 bp, Human
tcaagtaatccaggataggctg

SEQ ID NO: 142627 - DNA, 22 bp, Human
aacggaatcccaaaagcagctg

SEQ ID NO: 142628 - DNA, 22 bp, Human
ggcaagatgctggcatagctgt

SEQ ID NO: 142629 - DNA, 22 bp, Human
tattgcacttgtcccggcctgt

SEQ ID NO: 142630 - DNA, 22 bp, Human
atcacattgccagggattacca

SEQ ID NO: 142631 - DNA, 22 bp, Human
gaagtttgaagcctgttgttca

SEQ ID NO: 142632 - DNA, 22 bp, Human
cactgcactccagcctgggcaa

SEQ ID NO: 142633 - DNA, 22 bp, Human
taggtagtttcctgttgttggg

SEQ ID NO: 142634 - DNA, 22 bp, Human
tcacagtgaaccggtctctttc

SEQ ID NO: 142635 - DNA, 22 bp, Human
taaggtgcatctagtgcagtta

SEQ ID NO: 142636 - DNA, 22 bp, Human
ctagactgaagctccttgagga

SEQ ID NO: 142637 - DNA, 22 bp, Human
taatactgccgggtaatgatgg

SEQ ID NO: 142638 - DNA, 22 bp, Human
tagcagcacataatggtttgaa

SEQ ID NO: 142639 - DNA, 22 bp, Human
aaagtgctcatagtgcaggtag

SEQ ID NO: 142640 - DNA, 22 bp, Human
tttccacagcggccaattcttc

SEQ ID NO: 142641 - DNA, 22 bp, Human
agctgccagttgaagaacattt

SEQ ID NO: 142642 - DNA, 22 bp, Human
aagttaagagctcccaggcctg

SEQ ID NO: 142643 - DNA, 22 bp, Human
actgcactccagcctgggcaac

SEQ ID NO: 142644 - DNA, 22 bp, Human
gtgttccaggaagtcgtcttga

SEQ ID NO: 142645 - DNA, 22 bp, Human
tcaagctcattcctctaacctc

SEQ ID NO: 142646 - DNA, 22 bp, Human
cattgcactccagcctgggcaa

SEQ ID NO: 142647 - DNA, 22 bp, Human
acatgatctcctcactctagga

SEQ ID NO: 142648 - DNA, 22 bp, Human
aattgcttgaacccaggaagtg

SEQ ID NO: 142649 - DNA, 22 bp, Human
tgtttaagtagcttatttatct

SEQ ID NO: 142650 - DNA, 22 bp, Human
tctaagagaaaggaagttcaga

SEQ ID NO: 142651 - DNA, 22 bp, Human
gaaggcagtaggttgtatagtt

SEQ ID NO: 142652 - DNA, 22 bp, Human
atcacattgccagtgattaccc

SEQ ID NO: 142653 - DNA, 22 bp, Human
ttggagtaattcagtataggtt

SEQ ID NO: 142654 - DNA, 22 bp, Human
agtagacagtggcaacatagtc

SEQ ID NO: 142655 - DNA, 22 bp, Human
ctagcctgtttgtcctcacccc

SEQ ID NO: 142656 - DNA, 20 bp, Human
tgaggtgggatcccgaggcc

SEQ ID NO: 142657 - DNA, 17 bp, Human
tggctaggtaagggaag

SEQ ID NO: 142658 - DNA, 23 bp, Human
aatcatcattattttgaagttta

SEQ ID NO: 142659 - DNA, 17 bp, Human
taaggcatttttatggt

SEQ ID NO: 142660 - DNA, 22 bp, Human
gctgttgttaagggcacttggg

SEQ ID NO: 142661 - DNA, 22 bp, Human
ttcatgggagcaggtggtacag

SEQ ID NO: 142662 - DNA, 22 bp, Human
actgcactccagtctgggtgac

SEQ ID NO: 142663 - DNA, 22 bp, Human
tcactgcaacctctgcctcccg

SEQ ID NO: 142664 - DNA, 22 bp, Human
cagatcacatccatccgtcacc

SEQ ID NO: 142665 - DNA, 22 bp, Human
gcactcaagcctgggttacaga

SEQ ID NO: 142666 - DNA, 22 bp, Human
agagagtggcaggtctgttcct

SEQ ID NO: 142667 - DNA, 18 bp, Human
gatgaggcagcacttggg

SEQ ID NO: 142668 - DNA, 22 bp, Human
tgaggtgggagaattgcttgaa

SEQ ID NO: 142669 - DNA, 22 bp, Human
catgtaatcccagctactcagg

SEQ ID NO: 142670 - DNA, 22 bp, Human
tagcaccatttgaaatcggtta

SEQ ID NO: 142671 - DNA, 22 bp, Human
cagtgcaatgatgaaagggcat

SEQ ID NO: 142672 - DNA, 22 bp, Human
tgtaaacatccttgactggaag

SEQ ID NO: 142673 - DNA, 18 bp, Human
tttaaccgcatccttctc

SEQ ID NO: 142674 - DNA, 20 bp, Human
tactaatacgactcactaaa

SEQ ID NO: 142675 - DNA, 30 bp, Human
gactagctggaattcaaggatgcggttaaa

SEQ ID NO: 142676 - DNA, 30 bp, Human
cagccaacgctgcagatacgactcactaaa

SEQ ID NO: 142677 - DNA, 50 bp, Human
  misc_feature (50)..(50): n is a, c, g or t
  misc_feature (33)..(33): n=i
  misc_feature (37)..(38): n=i
  misc_feature (42)..(43): n=i
  misc_feature (47)..(48): n=i
aattaaccctcactaaaggctgcaggtgcaggngggnngggnngggnngn

SEQ ID NO: 142678 - DNA, 20 bp, Human
ggaattcaaggatgcggtta

SEQ ID NO: 142679 - DNA, 10 bp, Human
  misc_feature (3)..(4): n is a, c, g or t
  misc_feature (8)..(9): n is a, c, g or t
ggnngggnng

SEQ ID NO: 142680 - DNA, 12 bp, Human
tttaaccgcatc

SEQ ID NO: 142681 - DNA, 12 bp, Human
cgactcactaaa

SEQ ID NO: 142682 - DNA, 40 bp, Human
taatacgactcactataggcccttattagaggattctgct

SEQ ID NO: 142683 - DNA, 41 bp, Human
aattaaccctcactaaaggtttttttttcctgagacagagt

SEQ ID NO: 142684 - DNA, 42 bp, Human
taatacgactcactatagggtgaggtagtaagttgtattgtt

SEQ ID NO: 142685 - DNA, 41 bp, Human
aattaaccctcactaaagggaaagtagtaagttgtatagtt

SEQ ID NO: 142686 - DNA, 20 bp, Human
gaggcaggagaattgcttga

SEQ ID NO: 142687 - DNA, 39 bp, Human
aattaaccctcactaaaggcctgagacagagtcttgctc

SEQ ID NO: 142688 - DNA, 87 bp, Human
cccgtgaggaacagtggcgggattgtcccagggccccttccagcagggggacctcctgacttgagagtccccaaagccttcccaggg

SEQ ID NO: 142689 - DNA, 90 bp, Human
ctccacctgtttgctagcataacaggcgtgaaggcggcagtgtcgccggcgtccttccgcggaagcccagtgtgtgcagacagcacgggg

SEQ ID NO: 142690 - DNA, 60 bp, Human
tgggttcctggcatgctgatttgtgacttaagattaaaatcacattgccagggattacca

SEQ ID NO: 142691 - DNA, 126 bp, Human
ggtcgcgctcactgcagattggagaacaggtgcatctcgtagctcttctttggaaaacaaaagaagccaccagctgaggaagatgctcaccggtcaccgtccctttatttatgcccagcgatgacc

SEQ ID NO: 142692 - DNA, 74 bp, Human
aggtgcaggagcttagctgattggtgaacagtgattggtttccgctttgttcacagtggctaagttctgcacct

SEQ ID NO: 142693 - DNA, 88 bp, Human
ctctaacaaggtgcaggagcttagctgattggtgaacagtgattggtttccgctttgttcacagtggctaagttctgcacctgaagag

SEQ ID NO: 142694 - DNA, 81 bp, Human
tggggacagttaagttggagccgctggggcagaggccgttgctgacgggccggccgctgctgcacagtcagcttgggtgcg

SEQ ID NO: 142695 - DNA, 80 bp, Human
ggtcaaatgtattgaaagttgcaaaaattcttcttacaaacataaagtgtgctgaatccactacgtaaaccaaaatcaaa

SEQ ID NO: 142696 - DNA, 82 bp, Human
ggctgtgagcggggcggggcggggctttcggaggagctcctgttgttctgggcgcggtgaactctctcttgtatttgcagtc

SEQ ID NO: 142697 - DNA, 68 bp, Human
ctccggtgcctactgagctgatatcagttctcattttacacactggctcagttcagcaggaacaggag

SEQ ID NO: 142698 - DNA, 86 bp, Human
tagcagctattgtgtacgcaaagcctgagtacagcctgctggtgtcatggccacgtgtgagcaggccagcgtcacacggctcgctg

SEQ ID NO: 142699 - DNA, 705 bp, Homo Sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 142700 - DNA, 345 bp, Homo sapiens
cttttgagctgcttcttataatgtgtctcttgtgttaaggtgcatctagtgcagttagtgaagcagcttagaatctactgccctaaatgccccttctggcacaggctgcctaatatacagcattttaaaagtatgccttgagtagtaatttgaataggacacatttcagtggtttgttttttgcctttttattgtttgttgggaacagatggtggggactgtgcagtgtacagttgtgtacagaggataagattgggtcctagtagtaccaaagtgctcatagtgcaggtagttttggcatgactctactgtagtatgggcacttccagtactcttggataacaa
